US008778904B2

(12) United States Patent
Feinstein et al.

(10) Patent No.: US 8,778,904 B2
(45) Date of Patent: Jul. 15, 2014

(54) METHODS AND COMPOSITIONS FOR TREATING DISEASES, DISORDERS OR INJURY OF THE CNS

(75) Inventors: Elena Feinstein, Rehovot (IL); Igor Spivak, Haifa (IL); Evgenia Alpert, Jerusalem (IL); Ron Lahav, Kibbutz (IL)

(73) Assignee: Quark Pharmaceuticals, Inc., Fremont, CA (US)

( * ) Notice: Subject to any disclaimer, the term of this patent is extended or adjusted under 35 U.S.C. 154(b) by 0 days.

(21) Appl. No.: 13/514,880

(22) PCT Filed: Dec. 9, 2010

(86) PCT No.: PCT/US2010/059597
§ 371 (c)(1),
(2), (4) Date: Jun. 8, 2012

(87) PCT Pub. No.: WO2011/072091
PCT Pub. Date: Jun. 16, 2011

(65) Prior Publication Data
US 2012/0252875 A1 Oct. 4, 2012

Related U.S. Application Data

(60) Provisional application No. 61/319,894, filed on Apr. 1, 2010, provisional application No. 61/267,835, filed on Dec. 9, 2009.

(51) Int. Cl.
*A61K 48/00* (2006.01)
*A61K 49/00* (2006.01)
*C12N 15/113* (2010.01)
*A61K 31/00* (2006.01)

(52) U.S. Cl.
CPC .............. *C12N 15/113* (2013.01); *A61K 31/00* (2013.01); *A61K 49/00* (2013.01)
USPC ......................................... 514/44 A; 424/9.2

(58) Field of Classification Search
None
See application file for complete search history.

(56) References Cited

U.S. PATENT DOCUMENTS

2008/0108583 A1*  5/2008  Feinstein ..................... 514/44
2008/0287381 A1  11/2008  Thaler et al.
2011/0142917 A1  6/2011  Alpert et al.

FOREIGN PATENT DOCUMENTS

| WO | WO/2000/33814 | | 6/2000 |
| WO | WO 02/086105 A1 | | 10/2002 |
| WO | WO 02086105 A1 | * | 10/2002 |
| WO | WO 03/087368 A2 | | 10/2003 |
| WO | WO 2008024983 A2 | * | 2/2008 |
| WO | WO 2009/044392 A2 | | 4/2009 |

OTHER PUBLICATIONS

Chaudhary et al, Caspase inhibitors block the retinal ganglion cell death following optic nerve transection, 1999, Molecular brain research, 67:36-45.*
Kurokawa et al, BDNF Diminishes Caspase-2 but Not c-Jun Immunoreactivity of Neurons in Retinal Ganglion Cell Layer after Transient Ischemia, 1999, Investigative Ophtalmology & Visual Science, vol. 40, 12:3006-3011.*
McKinnon, Glaucoma: Ocular Alzheimer'S Disease?, 2003, Frontiers in Bioscience, 8, s1140-1156.*
Slater et al, Rodent Anterior Ischemic Optic Neuropathy (rAION) Induces Regional Retinal Ganglion Cell Apoptosis with a Unique Temporal Pattern, Aug. 2008, Investigative Ophtalmology & Visual Science, vol. 49, 8: 3671-3676.*
Oct. 4, 2011 Office Action in connection with Alpert E. et al., U.S. Appl. No. 12/994,725 (US 20110142917).
Response to Oct. 4, 2011 Office Action filed Jan. 4, 2012 in connection with Alpert E. et al., U.S. Appl. No. 12/994,725 (US 20110142917).
Jan. 24, 2012 Office Action in connection with Alpert E. et al., U.S. Appl. No. 12/994,725 (US 20110142917).
Response to Jan. 24, 2012 Office Action filed Jul. 24, 2012 in connection with Alpert E. et al., U.S. Appl. No. 12/994,725 (US 20110142917).
Supplemental Amendment filed Jul. 26, 2012 in connection with Alpert E. et al., U.S. Appl. No. 12/944,725 (US 20110142917).
Aug. 1, 2012 Final Office Action in connection with Alpert E. et al., U.S. Appl. No. 12/994,725 (US 20110142917).
Response to Aug. 1, 2012 Final Office Action filed Oct. 31, 2012 in connection with Alpert E. et al., U.S. Appl. No. 12/994,725 (US 20110142917).
Nov. 6, 2012 Advisory Action in connection with Alpert E. et al., U.S. Appl. No. 12/994,725 (US 20110142917).
Notification Concerning Transmittal of International Preliminary Report on Patentability (Chapter I of the Patent Cooperation Treaty), including an International Preliminary Report on Patentability and Written Opinion of the International Searching Authority, mailed Jun. 21, 2012 in connection with PCT International Application No. PCT/US2010/059597, filed Dec. 9, 2010.
Maeda et al. (2009). The therapeutic regulation of gene expression in the inner ear using RNA interference. *Adv Otorhinolaryngol*, 66, 13-36.
International Search Report, mailed Apr. 28, 2011 in connection with PCT International Application No. PCT/US2010/059597, filed Dec. 9, 2010.
Official Communication pursuant to Rules 161/162, issued by the European Patent Office on Jul. 20, 2012, in connection with European Patent Application No. 10809113.3.
Response to Official Communication pursuant to Rules 161/162, filed on Jan. 28, 2013, in connection with European Patent Application No. 10809113.3.
Amended Claims filed in response to Official Communication pursuant to Rules 161/162, filed on Jan. 28, 2013, in connection with European Patent Application No. 10809113.3.

* cited by examiner

*Primary Examiner* — Tracy Vivlemore
*Assistant Examiner* — Kate Poliakova-Georgantas
(74) *Attorney, Agent, or Firm* — John P. White; Cooper & Dunham LLP

(57) ABSTRACT

The present invention relates to non-invasive methods for treating diseases, disorders and injury to the central nervous system (CNS), and in particular to otic compositions and to methods of use thereof.

20 Claims, 4 Drawing Sheets

FIGURE 1A
FIGURE 1B
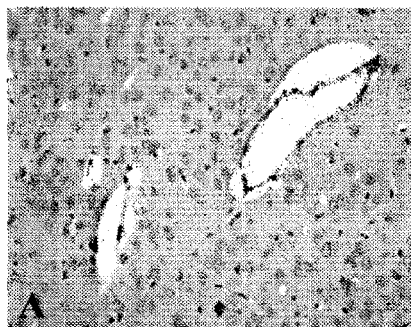
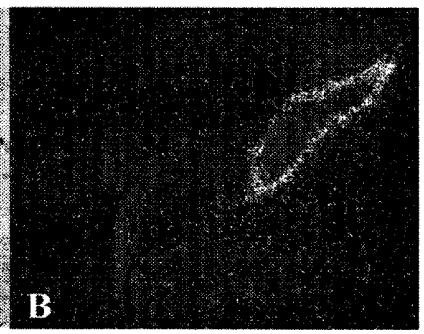
FIGURE 2A
FIGURE 2B
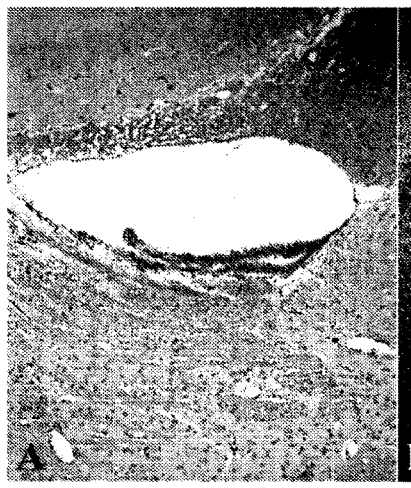
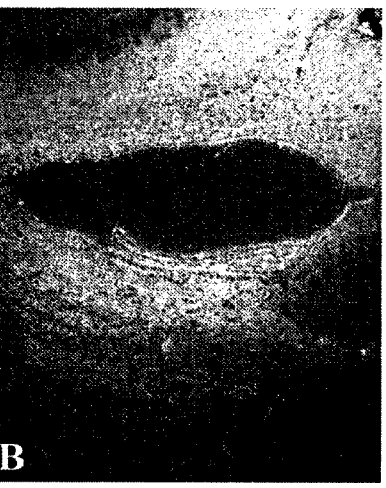

FIGURE 4A
FIGURE 4B
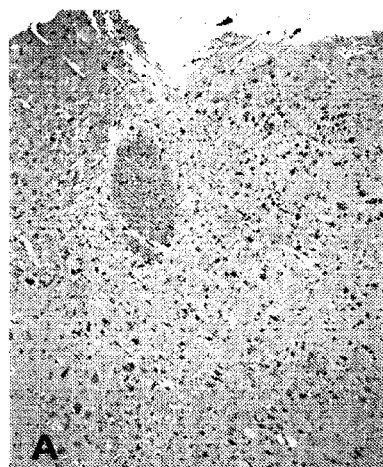
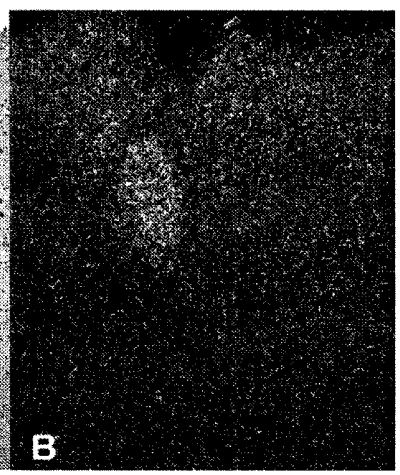
FIGURE 5
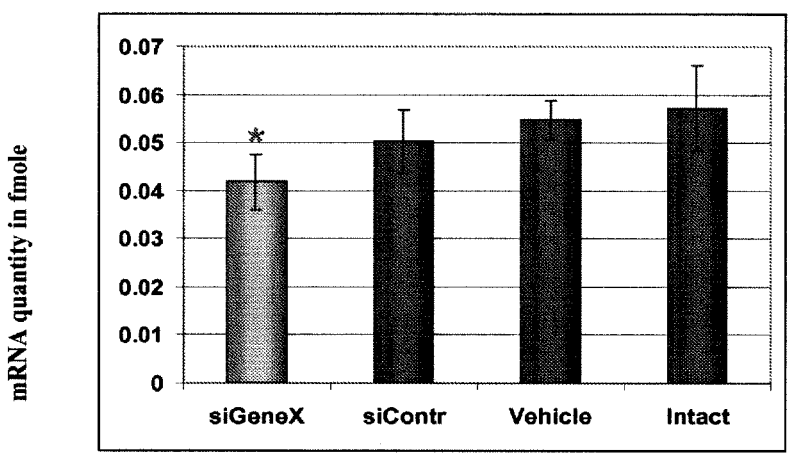

METHODS AND COMPOSITIONS FOR TREATING DISEASES, DISORDERS OR INJURY OF THE CNS

This application is a §371 national stage of PCT International Application No. PCT/US2010/059597, filed Dec. 9, 2010, claiming the benefit of U.S. Provisional Applications No. 61/319,894, filed Apr. 10, 2010 and 61/267,835, filed Dec. 9, 2009, the contents of each of which are hereby incorporated by reference in their entirety.

REFERENCE TO SEQUENCE LISTING

This application incorporates-by-reference nucleotide and/or amino acid sequences which are present in the file named "120608_2094_84156_Substitute_Sequence_Listing_GC.txt," which is 1.50 megabytes in size, and which was created Jun. 6, 2012 in the IBM-PC machine format, having an operating system compatibility with MS-Windows, which is contained in the text file filed Jun. 8, 2012 as part of this application.

FIELD OF THE INVENTION

The present invention relates to a method of treating a subject at risk of or afflicted with a disease, a disorder or an injury of the central nervous system (CNS), the method comprising administering an otic composition comprising a therapeutically effective amount of an oligonucleotide compound to the ear of the subject.

BACKGROUND OF THE INVENTION

Diseases, Disorders and Injury of the CNS

Diseases, disorders and injury of the CNS affect millions of people worldwide. With an increase in lifespan and changing population demographics, the incidence of CNS diseases is expected to increase significantly in the 21st century. The delivery of therapeutic oligonucleotide compounds to the CNS for effective treatment of CNS diseases, disorders and injury present a major challenge. For therapeutic purpose, it is important to consider not only the net delivery of a nucleic acid compounds to the CNS, but also the ability of the therapeutic oligonucleotide to access the relevant target site within the CNS.

Hitherto, the main approaches to delivery of oligonucleotide compounds to the CNS have been systemic administration, injection into cerebrospinal fluid (CSF) pathways and direct injection into the brain. For instance, modulation of the expression of certain genes involved in Alzheimer's diseases (AD), as well as that of genes involved in Huntington's disease has been attained in vivo by intrathecal and intracerebroventricular administration, implantation of catheters and pumps, by chemical or osmotic opening of the blood-brain barrier, by direct injection or perfusion at the site of injury or lesion, or by direct injection or perfusion into the arterial system of the brain (see for example WO 2005/003350, US 20050042646 and GB 2415961).

Intranasal administration of therapeutic oligonucleotide compounds for the treatment of CNS diseases has been described in WO 02/086105 and WO 2007/107789.

There remains a need for an effective method for delivery of therapeutic oligonucleotides to the CNS useful in treating diseases, disorders and injury of the CNS.

SUMMARY OF THE INVENTION

This disclosure is directed to non-invasive methods of treating a subject afflicted with a disease, disorder or injury of the central nervous system (CNS) comprising administering to the subject's ear canal an otic composition comprising at least one therapeutic oligonucleotide which targets a gene associated with the disease, disorder or injury. Hitherto, oligonucleotides have allegedly been delivered to the CNS tissue by systemic administration, injection into cerebrospinal fluid (CSF) and direct injection into the brain, as well as by intranasal administration. Provided herein are otic compositions, and methods of use thereof for treating diseases, disorders and injury of the CNS. The method disclosed herein provides an alternative to invasive delivery of therapeutics to the CNS with greater patient comfort and compliance.

Provided herein are methods for inhibiting loss of a retinal ganglion cell or for rescuing a retinal ganglion cell from apoptosis in a subject, comprising applying to the ear of the subject an otic composition comprising a therapeutically effective amount of at least one double stranded RNA compound which down regulates expression of a target gene associated with loss of the retinal ganglion cell, thereby inhibiting loss of the retinal ganglion cell or rescuing a retinal ganglion cell in the subject.

In some embodiments the subject is suffering from an ocular disease, an ocular disorder or an ocular injury or at risk of developing an ocular disease, an ocular disorder, or an ocular injury.

In some embodiments the ocular disease, disorder, or injury comprises neurodegeneration, increased intraocular pressure and or optic nerve injury.

In some embodiments the disease, disorder, or injury is selected from a group consisting of glaucoma, diabetic retinopathy (DR), diabetic macular edema (DME), age related macular degeneration (AMD), Leber's hereditary optic neuropathy (LHON), Leber optic atrophy, optic neuritis, retinal artery occlusion, central retinal vein occlusion, brunch retinal vein occlusion, ischemic optic neuropathy, optic nerve injury, retinopathy of prematurity (ROP) or retinitis pigmentosa (RP), retinal ganglion degeneration, macular degeneration, hereditary optic neuropathy, metabolic optic neuropathy, optic neuropathy due to a toxic agent or neuropathy caused by adverse drug reactions or vitamin deficiency.

In preferred embodiments the disease is glaucoma or ischemic optic neuropathy.

In some embodiments the otic composition is formulated as a cream, a foam, a paste, an ointment, an emulsion, a liquid solution, an ear drop, a gel, spray, a suspension, a microemulsion, microspheres, microcapsules, nano spheres, nanoparticles, lipid vesicles, liposomes, polymeric vesicles, a patch, or an insert.

In preferred embodiments the otic composition is formulated as an ear drop. In some embodiments the ear drop is topically applied to the ear canal. In preferred embodiments the ear drop is topically applied to the tympanic membrane. In some embodiments the composition is applied transtympanically.

In some embodiments the target gene is set forth in any one of SEQ ID NO:1-293. In some embodiments the target gene is set forth in any one of SEQ ID NO:22-23.

Provided herein is a method of rescuing a retinal ganglion cell from apoptosis in a subject, comprising applying to ear canal of the subject an otic composition comprising a therapeutically effective amount of at least one double stranded RNA compound targeting a gene in the retina of the subject, thereby rescuing retinal ganglion cell from apoptosis in the subject.

Further provided herein is a method for promoting survival of a retinal ganglion cell in a subject displaying signs or symptoms of an ocular neuropathy, comprising applying to ear of the subject an otic composition comprising a therapeutically effective amount of at least one double stranded RNA compound to a target gene that promotes survival of a retinal ganglion cell, thereby promoting survival of a retinal ganglion cell in the subject.

In some embodiments the signs or symptoms are mediated by apoptosis.

In some embodiments provided are methods for preventing, treating or alleviating the effects of an ocular disease associated with death of a retinal ganglion cell in a subject, comprising applying to the ear of the subject an otic composition comprising a therapeutically effective amount of at least one double stranded RNA compound to a target gene associated with the ocular disease, thereby preventing, treating or alleviating the effects of an ocular disease associated with death of a retinal ganglion cell in the subject.

In some embodiments retinal ganglion cell death is mediated by elevated intraocular pressure (IOP) in the eye of a subject or results from an ischemic event.

Provided herein is a method of delaying, preventing or rescuing a retinal cell from death in a subject suffering from elevated IOP comprising applying to the ear of the subject an otic composition comprising a therapeutically effective amount of at least one double stranded RNA compound to a target gene associated with death of the RGC in the retina of the subject, thereby delaying, preventing or rescuing the retinal cell from injury or death and wherein intraocular pressure (IOP) remains substantially elevated.

In some embodiments the subject is afflicted with glaucoma.

Provided herein is a method treating a subject suffering from retinal ganglion cell loss or retinal ganglion cell damage, comprising administering to the ear of the subject an otic composition comprising a therapeutically effective amount of at least one double stranded RNA compound to a target gene associated with the retinal ganglion cell loss or damage, thereby treating the subject or reducing retinal ganglion cell death in the subject.

Further provided is a method for attenuating retinal ganglion cell loss and providing ocular neuroprotection to a subject in need thereof, comprising applying to the ear of the subject an otic composition comprising a therapeutically effective amount of at least one double stranded RNA compound to a target gene associated with retinal ganglion cell loss, thereby attenuating retinal ganglion cell loss and providing ocular neuroprotection to the subject.

Also provided is a method for preventing visual field loss associated with loss of retinal ganglion cells in a subject, comprising administering to the ear of the subject an otic composition comprising a therapeutically effective amount of at least one double stranded RNA compound to a target gene in the retina of the subject, thereby preventing visual field loss in the subject.

Provided herein is a method of delivering a therapeutic oligonucleotide to the CNS of a subject suffering from a disease, a disorder or an injury of the CNS comprising topically administering to the subject's ear canal an otic composition comprising an effective amount of the oligonucleotide which targets a gene associated with the disease, disorder or injury, and a pharmaceutically acceptable excipient or mixtures thereof, thereby reducing expression of the gene and treating the subject.

In yet another aspect, the present invention provides a method of attenuating expression of a target mRNA in a subject suffering from a disease, a disorder or an injury of the CNS, which comprises applying to the subject's ear canal an otic composition comprising an effective amount an oligonucleotide directed to the target gene, and a pharmaceutically acceptable excipient or mixtures thereof, thereby attenuating expression of the target gene in the subject.

In some embodiments the CNS injury comprises injury to the retina including retinal ganglion cells (RGC) and/or the optic nerve (ON). In some embodiments the injury to the retina or optic nerve comprises ischemia or hypoxia injury.

In some embodiments provided is a method of protecting neuronal cells from cell death in a subject having or at risk of having a neurodegenerative or neurological disease comprising applying to the subject's ear canal a composition comprising a therapeutically effective amount of an oligonucleotide that inhibits a gene associated with the neuronal cell death thereby providing neuroprotection to the neuronal cells. In some embodiments the neuronal cells are present in the CNS. In some embodiments the neuronal cells are cells of the spinal cord. In some embodiments the neuronal cells are retinal ganglion cells or optic nerve cells. In some embodiments the neuronal cells are brain cells.

In some embodiments provided herein is a method of protecting neuronal cells from cell death in a subject having or at risk of having an injury to the CNS comprising applying to the subject's ear canal a composition comprising a therapeutically effective amount of an oligonucleotide that inhibits a gene associated with the neuronal cell death; and a pharmaceutically acceptable excipient or mixtures thereof, thereby providing neuroprotection to the neuronal cells. In some embodiments the injury is injury to the optic nerve and/or retinal ganglion cells.

Further disclosed is a method of providing neuroprotection from disease or injury to the CNS in a subject in need thereof, which comprises administering to the subject's ear canal an otic composition comprising at least one oligonucleotide directed to a target gene associated with the neural damage; and a pharmaceutically acceptable excipient or mixtures thereof, thereby reducing expression of the target gene in an amount to afford neuroprotection.

In some embodiments provided is a method of promoting neurogenesis or neuroregeneration in a subject in need thereof comprising applying to the subject's ear canal a composition comprising a therapeutically effective amount of an oligonucleotide that inhibits a target gene; and a pharmaceutically acceptable excipient or mixtures thereof, thereby promoting neurogenesis or neuroregeneration in the subject. In some embodiments the target gene is RhoA or a gene within the RhoA pathway. In some embodiments the oligonucleotide is administered in combination with a neurotrophic factor including NGF, BDNF or CNTF.

In another embodiment the provided is a method of treating a subject afflicted with a disease, disorder or injury to the CNS, which comprises applying to the subject's ear canal an otic composition comprising at least one oligonucleotide directed to a target gene associated with the disease, disorder or injury; and a pharmaceutically acceptable excipient or mixtures thereof, thereby treating the subject.

In some embodiments the disease or disorder comprises intraocular pressure. In some embodiments the disease is glaucoma. In some embodiments the injury is ischemic injury to the optic nerve.

In some embodiments provided is a method for reducing neurological inflammation in a subject having or at risk of having a disease, disorder or injury of the CNS, comprises applying to the subject's ear canal an otic composition comprising at least one oligonucleotide directed to a target gene associated with the disease, disorder or injury; and a pharmaceutically acceptable excipient or mixtures thereof, thereby reducing neurological inflammation in the subject.

In another embodiment provided is a method of treating a subject at risk of retinal degeneration, which comprises applying to the subject's ear canal an otic composition comprising at least one oligonucleotide directed to a target gene associated with the retinal degeneration; and a pharmaceutically acceptable excipient or mixtures thereof, thereby reducing the risk of retinal degeneration in the subject.

In one embodiment the present invention provides a method of treating a subject suffering from retinal degeneration, which comprises applying to the subject's ear canal an otic composition comprising at least one oligonucleotide directed to a target gene associated with the retinal degeneration; and a pharmaceutically acceptable excipient or mixtures thereof, thereby treating the subject. In some embodiments the target gene is Caspase 2 (CASP2).

Accordingly, in one aspect the present invention provides a method of non-invasive delivery of an oligonucleotide to a retinal tissue in a subject suffering from an eye disorder, disease or injury comprising topically applying an otic composition comprising an oligonucleotide compound to the ear canal of the subject.

In another aspect the present invention provides a method of non-invasive delivery of an oligonucleotide to a retinal ganglion cell in a subject suffering from an eye disorder comprising topically applying an otic composition comprising an oligonucleotide compound to the ear canal of the subject.

In yet another aspect, the present invention provides a method of attenuating expression of a target gene associated with loss of a retinal ganglion cell in the retina in a subject suffering from an ocular disease, disorder or injury, which comprises topically (non-invasively) administering to the ear canal of the subject a pharmaceutical composition comprising at least one oligonucleotide directed to the target mRNA product of the target gene, in an amount and over a period of time effective to attenuate expression of the gene in the retina of the subject.

In a further aspect, the present invention provides a method of treating a subject suffering from retinal ganglion cell loss or retinal ganglion cell damage and providing ocular neuroprotection to a subject suffering from or at risk of developing an eye disease, disorder or injury. The method comprises topically administering to the ear canal of the subject an otic pharmaceutical composition comprising at least one oligonucleotide directed to a target gene in the retina of the subject, in an amount and over a period of time effective to inhibit retinal ganglion cell loss or retinal ganglion cell damage in the subject.

In some embodiments the CNS injury results from exposure to a neurotoxin. Accordingly, in yet another aspect the invention provides a method of treating neurotoxicity in a subject in need thereof, which comprises administering to the subject's ear canal an otic pharmaceutical composition comprising at least one oligonucleotide directed to a target gene associated with neurotoxicity in the CNS, and a pharmaceutically acceptable excipient or mixtures thereof, thereby reducing expression of a gene associated with the neurotoxicity in the CNS of the subject in an amount and over a period of time effective to treat the subject.

In various embodiments the otic pharmaceutical compositions further comprises a permeability enhancer, also known as penetration enhancer.

Accordingly, the present invention provides a method of treating a subject suffering from or at risk of a disease, a disorder or an injury of the CNS which comprises topically administering to the canal of the subject's ear an otic pharmaceutical composition comprising: (a) a therapeutically effective amount of at least one oligonucleotide compound which inhibits the expression of a human target gene associated with a disease, a disorder or an injury of the CNS; (b) a permeability enhancer and (c) a pharmaceutically acceptable excipient or carrier, or mixtures thereof, thereby treating the subject.

In various embodiments the penetration enhancer is selected from any compound or any combination of two ore more compounds that enhance the penetration of a therapeutic oligonucleotide through the skin and/or the tympanic membrane in the ear of a subject suffering from or at risk of a disease, a disorder or an injury of the CNS. In certain embodiments the permeability enhancer is a polyol. In some embodiments the oligonucleotide is in admixture with a polyol. In some embodiments the polyol is selected from the group consisting of glycerol, propylene glycol, polyethylene glycol, sorbitol, xylitol, maltitol and combinations thereof.

According to one embodiment the polyol is glycerol. In various embodiments glycerol is present at a final concentration of about 0.1% to about 35%; about 1% to about 30%; about 5% to about 25%, preferably about 10% to about 20% by volume of the otic pharmaceutical composition. In some embodiments the final concentration of glycerol in the pharmaceutical composition is about 2%, 2.5%, 5%, 10%, 12.5%, 15%, 17.5%, 20%, 22.5%, 25%, 27.5% or about 30% by volume of the otic pharmaceutical composition. In one embodiment, the final concentration of glycerol in the pharmaceutical composition is about 2% by volume of the otic pharmaceutical composition. In one preferred embodiment, the final concentration of glycerol in the pharmaceutical composition is about 10% by volume of the otic pharmaceutical composition. In another embodiment, the final concentration of glycerol in the pharmaceutical composition is about 20% by volume of the otic pharmaceutical composition. In some embodiments the pharmaceutical composition is brought to the subject's body temperature, which is about 30° C. to about 38° C., prior to application to the ear.

In some embodiments, the pharmaceutical composition is applied to the ear canal when the subject's head is tilted to one side and the treated ear is facing upward. In some embodiments, the pharmaceutical composition is applied to the ear using a receptacle for eardrops, for example using a dropper of for example, 10-100 microliter per drop, or a wick.

In some embodiments the at least one oligonucleotide compound is selected from chemically modified double stranded RNA, unmodified double stranded RNA, antisense, ribozyme, miRNA and shRNA compound. In preferred embodiments the at least one oligonucleotide is a chemically modified double stranded RNA compound.

Without limitation in various embodiments the target mRNA is a product of a gene selected from the group consisting of APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2 (p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7 and EFNB2. In preferred embodiments the oligonucleotide is chemically modified according to the embodiments of the present invention.

In certain embodiments attenuating expression of at least one target mRNA confers upon the cells and/or tissues of the CNS neuroprotective properties.

APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2 (p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7 and EFNB2In preferred embodiments the double stranded RNA compound is chemically modified according to the embodiments of the present invention.

In certain embodiments inhibiting expression of at least one target gene confers upon the cells and/or tissues of the CNS neuroprotective properties.

In certain embodiments the at least one target mRNA is selected from an mRNA polynucleotide set forth in any one of SEQ ID NOS:1-293. In certain embodiments the at least one target gene is selected from a gene transcribed into an mRNA polynucleotide set forth in any one of SEQ ID NOS:1-293.

In various embodiments the otic oligonucleotide composition is administered to the external ear, including the ear canal of a subject by any suitable mode of administration. Suitable modes of administration of the otic oligonucleotide compositions of the invention include invasive and non-invasive modes of administration, such as without being limited to, instillation (of ear drops), injection, deposition, or spraying into the ear. In certain embodiments, the compositions of the present invention are administered topically into the ear canal as eardrops or injected through a cannula into the ear canal or injected through the tympanic membrane (transtympanic injection). In some embodiments, the method employs applying the pharmaceutical composition to the subject's ear canal when the subject's head is tilted to one side and the treated ear is facing upward. In some embodiments, the pharmaceutical composition is applied to the ear using a receptacle for eardrops, for example using a dropper of for example, 10-100 microliter per drop, or a wick. In certain embodiments the compositions of the present invention are brought to the subject's body temperature, which is about 30° C. to about 38° C., prior to application to the ear.

In one embodiment the at least one double stranded RNA compound is delivered to the ear of a subject in a pharmaceutical composition formulated as an eardrop. Thus, the present invention provides a non-invasive method of attenuating expression of a target mRNA in a subject suffering from a disease, a disorder or an injury of the CNS, which comprises topically administering into the ear canal of the subject a pharmaceutical composition formulated as an ear drop comprising at least one oligonucleotide directed to the target mRNA, in an amount and over a period of time effective to attenuate expression of the target mRNA in the CNS of the subject. In a further aspect, the present invention provides a method of treating a disease, a disorder or an injury of the CNS in a subject in need thereof, which comprises topically administering to the ear canal of the subject a pharmaceutical composition formulated as an ear drop, comprising at least one oligonucleotide directed to a target gene associated with the disease, the disorder or the injury of the CNS, in an amount and over a period of time effective to treat the subject.

In some embodiments the disease, disorder or injury of the central nervous system (CNS) is selected from eye disorder, neurodegenerative disease, spinal cord disease, traumatic and non-traumatic spinal cord injury, traumatic brain injury, cancer in the central nervous system (CNS), neurological disorder, mood disorders and other diseases associated with inflammation and/or neurotoxicity and/or oxidative stress in the CNS.

In some embodiments the eye disorder, disease or injury is selected from glaucoma, diabetic retinopathy (DR), diabetic macular edema (DME), age related macular degeneration (AMD) Leber's hereditary optic neuropathy (LHON) or Leber optic atrophy. In some embodiments the disorder is a primary glaucoma, selected from primary open angle glaucoma, normal-tension glaucoma or angle-closure glaucoma. In some embodiments the disorder is a secondary glaucoma selected from pseudoexfoliation glaucoma, pigmentary glaucoma, neovascular glaucoma, steroid-induced glaucoma or treatment refractory glaucoma. In other embodiments the ocular disorder, disease or injury is optic neuritis, retinal artery occlusion, central retinal vein occlusion, brunch retinal vein occlusion (BRVO). In further embodiments the eye disorder, disease or injury is retinitis pigmentosa (RP), ischemic optic neuropathy or optic nerve injury. In some embodiment the optic neuropathy is selected from non-arteritic anterior ischemic optic neuropathy (NAION), optic neuritis, neuromyelitis optica, dominant optic atrophy, Leber's hereditary optic neuropathy. In further embodiments ocular disorder, disease or injury is retinopathy of prematurity (ROP) retinal ganglion degeneration, macular degeneration, hereditary optic neuropathy, metabolic optic neuropathy, optic neuropathy due to a toxic agent or neuropathy caused by adverse drug reactions or vitamin deficiency. In yet another embodiment the disorder is vision loss associated with a tumor.

In various embodiments the neurodegenerative disorder is selected from neurodegenerative conditions causing problems with movements, such as impairment of motor, sensory or autonomic function; and conditions affecting memory and related to cognitive impairment or dementia. In various embodiments the neurodegenerative disorder is selected from, without being limited to, Parkinson's disease, Amyotrophic Lateral Sclerosis (ALS, also referred to as Lou Gehrig's Disease), Prion disease dementia, amnestic mild cognitive impairment, Alzheimer's disease, Lewy body dementia, Pick's disease, Ataxia-telangiectasia (AT), Frontotemporal dementia (FTD), Frontotemporal lobar degeneration (FTLD), Huntington's disease and any other disease-induced dementia (including, HIV-associated dementia and post-stroke dementia, for example).

In other embodiments the disorder is a neurological disorder selected from, without being limited to, non-traumatic neurological disease that affects the spinal cord, stroke, epilepsy, Parkinsonism, Gluten Ataxia, cerebral ischemia and cerebrovascular accident.

In some embodiments the disease or disorder is a neoplasm in the CNS selected from any intracranial tumor created by abnormal and uncontrolled cell division either in the brain itself or spread from cancers primarily located in other organs (i.e. metastatic tumors). In various embodiments the neoplasm in the CNS is created by abnormal proliferation of or in the, inter alia, neurons (e.g. Motor neuron, Purkinje neuron, GABAergic neuron, Multipolar neuron, Cerebellar neuron, Afferent neuron, Sensory neuron), glial cells (e.g. astrocytes, microglia, oligodendrocytes), ependymal cells, lymphatic tissue, blood vessels, cranial nerves, myelin-producing Schwann cells, meninges, skull, Striatum, Nucleus of stria terminalis, hypothalamus, pituitary gland and pineal gland.

In various embodiments the neoplasm in the CNS is an intracranial glioma selected from, without being limited to, ependymoma, glioma, astrocytoma, oligodendroglioma and oligoastrocytoma. In further embodiments the intracranial glioma is selected from Pilocytic astrocytoma of cerebellum and Oligodendroglioma of brain.

In some embodiments the neoplasm is a neural crest tumor such as e.g. cranial primitive neuroectodermal tumors (PNET). In various embodiments the neoplasm is selected from, without being limited to, Medulloblastoma of cerebellum, Neuroblastoma of brain, Glioblastoma multiforme of brain and Neurofibromatosis.

In yet other embodiments the disease or disorder of the CNS is selected from, without being limited to, Supranuclear paralysis, Lymphocytic choriomeningitis, Niemann Pick disease (e.g. Niemann Pick disease Type C) and AF type amyloidosis (Familial neuropathic amyloidosis).

In some embodiments the injury of the CNS is selected from, without being limited to, traumatic and non-traumatic spinal cord injury, and brain injury (e.g. Traumatic Brain Injury (TBI)), that is caused by fracture or penetration of the skull (e.g. a vehicle accident, fall, gunshot wound), a disease process (e.g. neurotoxins, infections, tumors, metabolic abnormalities, etc.) or a closed head injury such as in the case of rapid acceleration or deceleration of the head (e.g. Shaken Baby Syndrome, blast), blunt trauma, concussions, and concussion syndrome.

In certain embodiments the disease or disorder of the CNS is selected from mood disorders (e.g. major depressive disorder and bipolar disorder) and Post-traumatic stress disorder (PTSD).

In other embodiments the disease, disorder or injury of the central nervous system (CNS) is selected from a disease associated with inflammation and/or neurotoxicity and/or oxidative stress in the CNS, such as, without being limited to, demyelinating disease (e.g. Multiple Sclerosis, Acute Inflammatory Demyelinating Polyradiculoneuropathy (AIDP), Chronic Inflammatory demyelinating polyradiculoneuropathy (CIDP), Guillain-Barré syndrome (GBS)).

According to another aspect, the present invention provides an otic pharmaceutical composition comprising: (a) a therapeutically effective amount of at least one oligonucleotide compound which inhibits the expression of a human target gene associated with a disease, a disorder or an injury of the CNS, wherein the target gene is selected from one or more of: APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2(p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7, EFNB2; (b) a permeability enhancer; and optionally (c) a pharmaceutically acceptable excipient or carrier, or mixtures thereof.

In preferred embodiments the at least one oligonucleotide compound is a chemically double stranded RNA compound. In some preferred embodiments the at least one oligonucleotide compound is a chemically modified siRNA.

Otic pharmaceutical composition of the invention is useful with any oligonucleotide pair (sense and antisense strands) to a mammalian gene or non-mammalian gene. In some embodiments the mammalian gene is a human gene. In some embodiments the non-mammalian gene is involved in a mammalian disease, preferably human disease. In various embodiments the human gene is selected from the group consisting of genes having mRNA set forth in any one of SEQ ID NOS: 1-293. Examples of oligonucleotide sequence pairs are provided in PCT Patent Publication Nos. WO 2006/023544, WO 2007/084684, WO 2008/050329, WO 2007/141796, WO 2009/044392, WO 2008/106102, WO 2008/152636, WO 2009/001359, WO/2009/090639 assigned to the assignee of the present invention and incorporated herein by reference in their entirety.

In various embodiments the penetration enhancer is selected from any compound or any combination of two ore more compounds that enhance the penetration of a therapeutic oligonucleotide through the skin and/or the tympanic membrane in the ear of a subject suffering from or at risk of a disease, a disorder or an injury of the CNS. In certain embodiments the permeability enhancer is a polyol. In some embodiments the oligonucleotide is in admixture with a polyol. In some embodiments the polyol is selected from the group consisting of glycerol, propylene glycol, polyethylene glycol, sorbitol, xylitol, maltitol, and combinations thereof. According to one embodiment the polyol is glycerol. In various embodiments glycerol is present at a final concentration of about 0.1% to about 35%; about 1% to about 30%; about 5% to about 25%, preferably about 10% to about 20% by volume of the otic pharmaceutical composition. In some embodiments the final concentration of glycerol in the pharmaceutical composition is about 2%, 2.5%, 5%, 10%, 12.5%, 15%, 17.5%, 20%, 22.5%, 25%, 27.5% or about 30% by volume of the otic pharmaceutical composition. In one embodiment, the final concentration of glycerol in the pharmaceutical composition is about 2% by volume of the otic pharmaceutical composition. In one preferred embodiment, the final concentration of glycerol in the pharmaceutical composition is about 10% by volume of the otic pharmaceutical composition. In another embodiment, the final concentration of glycerol in the pharmaceutical composition is about 20% by volume of the otic pharmaceutical composition. In certain embodiments the otic pharmaceutical composition is brought to the subject's body temperature, which is about 30° C.-38° C., prior to application to the ear.

The methods, materials, and examples that will now be described are illustrative only and are not intended to be limiting; materials and methods similar or equivalent to those described herein can be used in practice or testing of the invention. Other features and advantages of the invention will be apparent from the following detailed description, and from the claims.

This disclosure is intended to cover any and all adaptations or variations of combination of features that are disclosed in the various embodiments herein. Although specific embodiments have been illustrated and described herein, it should be appreciated that the invention encompasses any arrangement of the features of these embodiments to achieve the same purpose. Combinations of the above features, to form embodiments not specifically described herein, will be apparent to those of skill in the art upon reviewing the instant description.

BRIEF DESCRIPTION OF THE FIGURES

FIG. 1: CASP2_4_S510 siRNA (siCASP2) hybridization signals in brain section, 6 h post ErD application of siRNA (#53). Bright (A) and dark (B) field images demonstrating two adjacent blood vessels, one of which is siRNA positive while the other is not (Original magnification ×20, 12 days exposure). (Example 4)

FIG. 2: Lateral ventricle and adjacent tissue (#54. Original magnification ×10. Exposure 6 days). When siRNA appeared in ventricles (probably through cerebrospinal fluid CSF), it was also absorbed into the adjacent brain tissue (hippocampus, striatum, thalamus). (Example 4)

FIG. 4: CASP2_4_S510 siRNA signal in facial nerve—7n (#54. Original magnification ×10. Exposure 1d). (Example 4)

FIG. 5: CASP2 gene knockdown (bar designated as "siGeneX") in the rat retina at 24 hours after administration of otic composition administered via eardrops (Experimental Group II). In this figure CNL_1 ((Experimental Group IV) is identified as "siContr", 10% glycerol group ((Experimental Group VI) is identified as "Vehicle" and intact group (Experimental Group VII) is identified "Intact". (Example 7)

DETAILED DESCRIPTION OF THE INVENTION

Figure 3A:
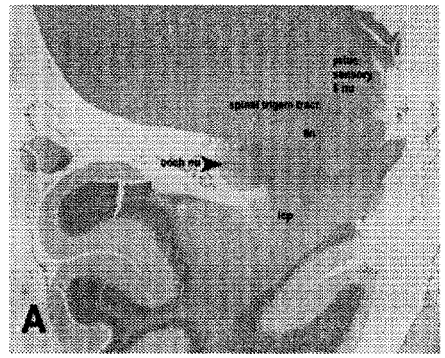
FIG. 3: CASP2_4_S510 siRNA signals in spinal trigeminal tract, principal sensory 5 nucleus, vestibule-cochlear nerve 8n, (#54. Original magnification A ×2.5, B & C ×10, exposure 1d). (Example 4)

The present invention provides topical oligonucleotide compositions, in particular, otic oligonucleotide compositions, and methods of use thereof for treating various diseases, disorders and injury of the Central Nervous System (CNS). The present invention is based in part on the surprising finding that auricular/otic administration of double stranded RNA compositions targets certain tissues and cell types of Central Nervous System (CNS). The finding is surprising in view of the known difficulties associated with delivery of therapeutic oligonucleotide compounds to the CNS for effective treatment of CNS diseases, disorders and injury.

In another aspect, the present invention now discloses non-invasive methods of treating CNS diseases, disorders and injury.

The present invention relates in general to otic pharmaceutical compositions that comprise a therapeutically effective amount of at least one oligonucleotide compound, which inhibits the expression of a target gene associated with a disease, a disorder or an injury of the CNS and to the use of these novel compositions in the treatment of a subject suffering from medical conditions associated with expression of those genes in CNS tissues and cells. In various preferred embodiments the oligonucleotide compound is a double stranded RNA compound, such as small interfering RNA (siRNA). Otic pharmaceutical composition of the invention is useful with any oligonucleotide pair (sense and antisense strands) to a mammalian gene or non-mammalian gene. In some embodiments the mammalian gene is a human gene. In some embodiments the non-mammalian gene is involved in a mammalian disease, preferably human disease.

In various embodiments the double stranded RNA compounds possess structures and modifications which increase activity, increase stability, minimize toxicity, reduce off target effects and/or reduce immune response when compared to an unmodified double stranded RNA compound; the modifications are beneficially applied to double stranded oligonucleotide sequences useful in preventing or attenuating target gene expression, in particular the target genes discussed herein.

In various specific embodiments, the present invention provides a method of treating a disease, a disorder or an injury of the CNS in a subject in need thereof, which comprises administering to the ear of the subject an otic pharmaceutical composition comprising at least one oligonucleotide directed to a target gene associated with the disease, the disorder or the injury of the CNS, in an amount and over a period of time effective to treat the subject. In a preferred embodiment the subject is a human subject.

Methods and otic pharmaceutical compositions, which inhibit target genes associated with a disease, a disorder or an injury of the CNS, are discussed herein at length. Diseases and conditions to be treated include but are not limited to a neurodegenerative disease, a neurological disorder, a malignancy or a tumor, an affective disorder, or nerve damage resulting from a cerebrovascular disorder, injury or infection of the CNS. In some embodiments the disease or condition of the CNS is a CNS disease associated with inflammation, a CNS disease associated with neurotoxicity, a disease associated with an oxidative stress in the CNS.

In certain embodiments, the target gene associated with a disease, a disorder or an injury of the CNS is selected from one or more of target genes are presented in Tables A, hereinbelow, i.e. APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2(p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7, and EFNB2.

TABLE A

| Target gene No. | Target gene symbol | SEQ NO, Full name and GI and accession number |
|---|---|---|
| 1 | APP | <SEQ_ID_NO: 1; RNA; Homo_Sapiens> gi|228008403|ref|NM_000484.3| *Homo sapiens* amyloid beta (A4) precursor protein (APP), transcript variant 1, mRNA <SEQ_ID_NO: 2; RNA; Homo_Sapiens> gi|228008404|ref|NM_201413.2| *Homo sapiens* amyloid beta (A4) precursor protein (APP), transcript variant 2, mRNA <SEQ_ID_NO: 3; RNA; Homo_Sapiens> gi|228008405|ref|NM_201414.2| *Homo sapiens* amyloid beta (A4) precursor protein (APP), transcript variant 3, mRNA <SEQ_ID_NO: 4; RNA; Homo_Sapiens> gi|228008402|ref|NM_001136129.2| *Homo sapiens* amyloid beta (A4) precursor protein (APP), transcript variant 5, mRNA <SEQ_ID_NO: 5; RNA; Homo_Sapiens> gi|228008401|ref|NM_001136130.2| *Homo sapiens* amyloid beta (A4) precursor protein (APP), transcript variant 6, mRNA |
| 2 | MAPT | <SEQ_ID_NO: 6; RNA; Homo_Sapiens> gi|294862260|ref|NM_016835.4| *Homo sapiens* microtubule-associated protein tau (MAPT), transcript variant 1, mRNA <SEQ_ID_NO: 7; RNA; Homo_Sapiens> gi|294862262|ref|NM_005910.5| *Homo sapiens* microtubule-associated protein tau (MAPT), transcript variant 2, mRNA <SEQ_ID_NO: 8; RNA; Homo_Sapiens> gi|294862264|ref|NM_016834.4| *Homo sapiens* microtubule-associated protein tau (MAPT), transcript variant 3, mRNA <SEQ_ID_NO: 9; RNA; Homo_Sapiens> gi|294862259|ref|NM_016841.4| *Homo sapiens* microtubule-associated protein tau (MAPT), transcript variant 4, mRNA <SEQ_ID_NO: 10; RNA; Homo_Sapiens> gi|294862254|ref|NM_001123067.3| *Homo sapiens* microtubule-associated protein tau (MAPT), transcript variant 5, mRNA <SEQ_ID_NO: 11; RNA; Homo_Sapiens> gi|294862257|ref|NM_001123066.3| *Homo sapiens* microtubule-associated protein tau (MAPT), transcript variant 6, mRNA |
| 3 | SOD1 | <SEQ_ID_NO: 12; RNA; Homo_Sapiens> GI|48762945|ref|NM_000454.4| *Homo sapiens* superoxide dismutase 1, soluble (SOD1), mRNA |
| 4 | BACE1 | <SEQ_ID_NO: 13; RNA; Homo_Sapiens> gi|46255011|ref|NM_012104.3| *Homo sapiens* beta-site APP-cleaving enzyme 1 (BACE1), transcript variant a, mRNA <SEQ_ID_NO: 14; RNA; Homo_Sapiens> gi|46255013|ref|NM_138972.2| *Homo sapiens* beta-site APP-cleaving enzyme 1 (BACE1), transcript variant b, mRNA <SEQ_ID_NO: 15; RNA; Homo_Sapiens> gi|46255012|ref|NM_138971.2| *Homo sapiens* beta-site APP-cleaving enzyme 1 (BACE1), transcript variant c, mRNA <SEQ_ID_NO: 16; RNA; Homo_Sapiens> gi|46255014|ref|NM_138973.2| *Homo sapiens* beta-site APP-cleaving enzyme 1 (BACE1), transcript variant d, mRNA |
| 5 | CASP1 | <SEQ_ID_NO: 17; RNA; Homo_Sapiens> gi|73622114|ref|NM_033292.2| *Homo sapiens* caspase 1, apoptosis-related cysteine peptidase (interleukin 1, beta, convertase) (CASP1), transcript variant alpha, mRNA <SEQ_ID_NO: 18; RNA; Homo_Sapiens> gi|73622112|ref|NM_001223.3| *Homo sapiens* caspase 1, apoptosis-related cysteine peptidase (interleukin 1, beta, convertase) (CASP1), transcript variant beta, mRNA <SEQ_ID_NO: 19; RNA; Homo_Sapiens> gi|73622118|ref|NM_033293.2| *Homo sapiens* caspase 1, apoptosis-related cysteine peptidase (interleukin 1, beta, convertase) (CASP1), transcript variant gamma, mRNA <SEQ_ID_NO: 20; RNA; Homo_Sapiens> gi|73622111|ref|NM_033294.2| *Homo sapiens* caspase 1, apoptosis-related cysteine peptidase (interleukin 1, beta, convertase) (CASP1), transcript variant delta, mRNA <SEQ_ID_NO: 21; RNA; Homo_Sapiens> gi|73622117|ref|NM_033295.2| *Homo sapiens* caspase 1, apoptosis-related cysteine peptidase (interleukin 1, beta, convertase) (CASP1), transcript variant epsilon, mRNA |
| 6 | CASP2 | <SEQ_ID_NO: 22; RNA; Homo_Sapiens> gi|39995058|ref|NM_032982.2| *Homo sapiens* caspase 2, apoptosis-related cysteine peptidase (neural precursor cell expressed, developmentally down-regulated 2) (CASP2), transcript variant 1, mRNA <SEQ_ID_NO: 23; RNA; Homo_Sapiens> gi|39995060|ref|NM_032983.2| *Homo sapiens* caspase 2, apoptosis-related cysteine peptidase (neural precursor cell expressed, developmentally down-regulated 2) (CASP2), transcript variant 3, mRNA |
| 7 | CASP3 | <SEQ_ID_NO: 24; RNA; Homo_Sapiens> GI|73622121|ref|NM_004346.3| *Homo sapiens* caspase 3, apoptosis-related cysteine peptidase (CASP3), transcript variant alpha, mRNA <SEQ_ID_NO: 25; RNA; Homo_Sapiens> GI|73622122|ref|NM_032991.2| *Homo sapiens* caspase 3, apoptosis-related cysteine peptidase (CASP3), transcript variant beta, mRNA |
| 8 | CASP9 | <SEQ_ID_NO: 26; RNA; Homo_Sapiens> GI|14790123|ref|NM_001229.2| *Homo sapiens* caspase 9, apoptosis-related cysteine peptidase (CASP9), transcript variant alpha, mRNA <SEQ_ID_NO: 27; RNA; Homo_Sapiens> GI|14790127|ref|NM_032996.1| *Homo sapiens* caspase 9, apoptosis-related cysteine peptidase (CASP9), transcript variant beta, mRNA |

TABLE A-continued mRNA of target genes for certain embodiments of the present invention

| Target gene No. | Target gene symbol | SEQ NO, Full name and GI and accession number |
|---|---|---|
| 9 | TGM2 | <SEQ_ID_NO: 28; RNA; Homo_Sapiens> GI\|39777596\|ref\|NM_004613.2\|<br>*Homo sapiens* transglutaminase 2 (C polypeptide, protein-glutamine-gamma-glutamyltransferase) (TGM2), transcript variant 1, mRNA<br><SEQ_ID_NO: 29; RNA; Homo_Sapiens> GI\|39777598\|ref\|NM_198951.1\|<br>*Homo sapiens* transglutaminase 2 (C polypeptide, protein-glutamine-gamma-glutamyltransferase) (UGM2), transcript variant 2, mRNA |
| 10 | TARDBP | <SEQ_ID_NO: 30; RNA; Homo_Sapiens> GI\|42741653\|ref\|NM_007375.3\|<br>*Homo sapiens* UAR DNA binding protein (TARDBP), mRNA |
| 11 | ADRB1 | <SEQ_ID_NO: 31; RNA; Homo_Sapiens> GI\|110349783\|ref\|NM_000684.2\|<br>*Homo sapiens* adrenergic, beta-1-, receptor (ADRB1), mRNA |
| 12 | CAMK2A | <SEQ_ID_NO: 32; RNA; Homo_Sapiens> GI\|212549564\|ref\|NM_015981.3\|<br>*Homo sapiens* calcium/calmodulin-dependent protein kinase II alpha (CAMK2A), transcript variant 1, mRNA<br><SEQ_ID_NO: 33; RNA; Homo_Sapiens> GI\|212549565\|ref\|NM_171825.2\|<br>*Homo sapiens* calcium/calmodulin-dependent protein kinase II alpha (CAMK2A), transcript variant 2, mRNA |
| 13 | CBLN1 | <SEQ_ID_NO: 34; RNA; Homo_Sapiens> GI\|294862296\|ref\|NM_004352.3\|<br>*Homo sapiens* cerebellin 1 precursor (CBLN1), mRNA |
| 14 | CDK5R1 | <SEQ_ID_NO: 35; RNA; Homo_Sapiens> GI\|34304373\|ref\|NM_003885.2\|<br>*Homo sapiens* cyclin-dependent kinase 5, regulatory subunit 1 (p35) (CDK5R1), mRNA |
| 15 | GABRA1 | <SEQ_ID_NO: 36; RNA; Homo_Sapiens> GI\|189083722\|ref\|NM_000806.5\|<br>*Homo sapiens* gamma-aminobutyric acid (GABA) A receptor, alpha 1 (GABRA1), transcript variant 1, mRNA<br><SEQ_ID_NO: 37; RNA; Homo_Sapiens> GI\|189083723\|ref\|NM_001127643.1\|<br>*Homo sapiens* gamma-aminobutyric acid (GABA) A receptor, alpha 1 (GABRA1), transcript variant 2, mRNA<br><SEQ_ID_NO: 38; RNA; Homo_Sapiens> GI\|189083725\|ref\|NM_001127644.1\|<br>*Homo sapiens* gamma-aminobutyric acid (GABA) A receptor, alpha 1 (GABRA1), transcript variant 3, mRNA<br><SEQ_ID_NO: 39; RNA; Homo_Sapiens> GI\|189083727\|ref\|NM_001127645.1\|<br>*Homo sapiens* gamma-aminobutyric acid (GABA) A receptor, alpha 1 (GABRA1), transcript variant 4, mRNA<br><SEQ_ID_NO: 40; RNA; Homo_Sapiens> GI\|189083729\|ref\|NM_001127646.1\|<br>*Homo sapiens* gamma-aminobutyric acid (GABA) A receptor, alpha 1 (GABRA1), transcript variant 5, mRNA<br><SEQ_ID_NO: 41; RNA; Homo_Sapiens> GI\|189083731\|ref\|NM_001127647.1\|<br>*Homo sapiens* gamma-aminobutyric acid (GABA) A receptor, alpha 1 (GABRA1), transcript variant 6, mRNA<br><SEQ_ID_NO: 42; RNA; Homo_Sapiens> GI\|189083733\|ref\|NM_001127648.1\|<br>*Homo sapiens* gamma-aminobutyric acid (GABA) A receptor, alpha 1 (GABRA1), transcript variant 7, mRNA |
| 16 | MAPK10 | <SEQ_ID_NO: 43; RNA; Homo_Sapiens> GI\|257467587\|ref\|NM_002753.3\|<br>*Homo sapiens* mitogen-activated protein kinase 10 (MAPK10), transcript variant 1, mRNA<br><SEQ_ID_NO: 44; RNA; Homo_Sapiens> GI\|257467594\|ref\|NM_138982.2\|<br>*Homo sapiens* mitogen-activated protein kinase 10 (MAPK10), transcript variant 2, mRNA<br><SEQ_ID_NO: 45; RNA; Homo_Sapiens> GI\|257467592\|ref\|NM_138980.2\|<br>*Homo sapiens* mitogen-activated protein kinase 10 (MAPK10), transcript variant 3, mRNA<br><SEQ_ID_NO: 46; RNA; Homo_Sapiens> GI\|257467593\|ref\|NM_138981.2\|<br>*Homo sapiens* mitogen-activated protein kinase 10 (MAPK10), transcript variant 4, mRNA |
| 17 | NOS1 | <SEQ_ID_NO: 47; RNA; Homo_Sapiens> GI\|194239671\|ref\|NM_000620.2\|<br>*Homo sapiens* nitric oxide synthase 1 (neuronal) (NOS1), mRNA |
| 18 | NPTX2 | <SEQ_ID_NO: 48; RNA; Homo_Sapiens> GI\|223671935\|ref\|NM_002523.2\|<br>*Homo sapiens* neuronal pentraxin II (NPTX2), mRNA |
| 19 | NRGN | <SEQ_ID_NO: 49; RNA; Homo_Sapiens> GI\|187131237\|ref\|NM_006176.2\|<br>*Homo sapiens* neurogranin (protein kinase C substRte, RC3) (NRGN), transcript variant 1, mRNA<br><SEQ_ID_NO: 50; RNA; Homo_Sapiens> GI\|187131238\|ref\|NM_001126181.1\|<br>*Homo sapiens* neurogranin (protein kinase C substRte, RC3) (NRGN), transcript variant 2, mRNA |
| 20 | NTS | <SEQ_ID_NO: 51; RNA; Homo_Sapiens> GI\|31563516\|ref\|NM_006183.3\|<br>*Homo sapiens* neurotensin (NTS), mRNA |
| 21 | PDCD2 | <SEQ_ID_NO: 52; RNA; Homo_Sapiens> GI\|21735591\|ref\|NM_002598.2\|<br>*Homo sapiens* programmed cell death 2 (PDCD2), transcript variant 1, mRNA<br><SEQ_ID_NO: 53; RNA; Homo_Sapiens> GI\|21735593\|ref\|NM_144781.1\|<br>*Homo sapiens* programmed cell death 2 (PDCD2), transcript variant 2, mRNA |
| 22 | PDE4A | <SEQ_ID_NO: 54; RNA; Homo_Sapiens> GI\|162329607\|ref\|NM_001111307.1\|<br>*Homo sapiens* phosphodiesterase 4A, cAMP-specific (phosphodiesterase E2 dunce homolog, *Drosophila*) (PDE4A), transcript variant 1, mRNA<br><SEQ_ID_NO: 55; RNA; Homo_Sapiens> GI\|162329609\|ref\|NM_001111308.1\|<br>*Homo sapiens* phosphodiesterase 4A, cAMP-specific (phosphodiesterase E2 dunce homolog, *Drosophila*) (PDE4A), transcript variant 2, mRNA<br><SEQ_ID_NO: 56; RNA; Homo_Sapiens> GI\|162329611\|ref\|NM_001111309.1\|<br>*Homo sapiens* phosphodiesterase 4A, cAMP-specific (phosphodiesterase E2 dunce homolog, *Drosophila*) (PDE4A), transcript variant 3, mRNA<br><SEQ_ID_NO: 57; RNA; Homo_Sapiens> GI\|162329606\|ref\|NM_006202.2\| |

TABLE A-continued mRNA of target genes for certain embodiments of the present invention

| Target gene No. | Target gene symbol | SEQ NO, Full name and GI and accession number |
|---|---|---|
| 23 | PDE4D | *Homo sapiens* phosphodiesterase 4A, cAMP-specific (phosphodiesterase E2 dunce homolog, *Drosophila*) (PDE4A), transcript variant 4, mRNA<br><SEQ_ID_NO: 58; RNA; Homo_Sapiens> GI\|157277987\|ref\|NM_001104631.1\|<br>*Homo sapiens* phosphodiesterase 4D, cAMP-specific (phosphodiesterase E3 dunce homolog, *Drosophila*) (PDE4D), transcript variant 1, mRNA<br><SEQ_ID_NO: 59; RNA; Homo_Sapiens> GI\|157277986\|ref\|NM_006203.4\|<br>*Homo sapiens* phosphodiesterase 4D, cAMP-specific (phosphodiesterase E3 dunce homolog, *Drosophila*) (PDE4D), transcript variant 2, mRNA<br><SEQ_ID_NO: 60; RNA; Homo_Sapiens> GI\|259906419\|ref\|NM_001165899.1\|<br>*Homo sapiens* phosphodiesterase 4D, cAMP-specific (phosphodiesterase E3 dunce homolog, *Drosophila*) (PDE4D), transcript variant 3, mRNA |
| 24 | PENK | <SEQ_ID_NO: 61; RNA; Homo_Sapiens> GI\|208879445\|ref\|NM_001135690.1\|<br>*Homo sapiens* proenkephalin (PENK), transcript variant 1, mRNA<br><SEQ_ID_NO: 62; RNA; Homo_Sapiens> GI\|208879444\|ref\|NM_006211.3\|<br>*Homo sapiens* proenkephalin (PENK), transcript variant 2, mRNA |
| 25 | SYT1 | <SEQ_ID_NO: 63; RNA; Homo_Sapiens> GI\|209447071\|ref\|NM_005639.2\|<br>*Homo sapiens* synaptotagmin I (SYT1), transcript variant 1, mRNA<br><SEQ_ID_NO: 64; RNA; Homo_Sapiens> GI\|209447069\|ref\|NM_001135805.1\|<br>*Homo sapiens* synaptotagmin I (SYT1), transcript variant 2, mRNA<br><SEQ_ID_NO: 65; RNA; Homo_Sapiens> GI\|209447072\|ref\|NM_001135806.1\|<br>*Homo sapiens* synaptotagmin I (SYT1), transcript variant 3, mRNA |
| 26 | TTR | <SEQ_ID_NO: 66; RNA; Homo_Sapiens> GI\|221136767\|ref\|NM_000371.3\|<br>*Homo sapiens* transthyretin (TTR), mRNA |
| 27 | FUS | <SEQ_ID_NO: 67; RNA; Homo_Sapiens> GI\|270265814\|ref\|NM_004960.3\|<br>*Homo sapiens* fused in sarcoma (FUS), transcript variant 1, mRNA<br><SEQ_ID_NO: 68; RNA; Homo_Sapiens> GI\|270265815\|ref\|NR_028388.2\|<br>*Homo sapiens* fused in sarcoma (FUS), transcript variant 2, non-coding RNA<br><SEQ_ID_NO: 69; RNA; Homo_Sapiens> GI\|283135200\|ref\|NM_001170634.1\|<br>*Homo sapiens* fused in sarcoma (FUS), transcript variant 3, mRNA<br><SEQ_ID_NO: 70; RNA; Homo_Sapiens> GI\|283135172\|ref\|NM_001170937.1\|<br>*Homo sapiens* fused in sarcoma (FUS), transcript variant 4, mRNA |
| 28 | LRDD | <SEQ_ID_NO: 71; RNA; Homo_Sapiens> GI\|61742783\|ref\|NM_145886.2\|<br>*Homo sapiens* leucine-rich repeats and death domain containing (LRDD), transcript variant 1, mRNA<br><SEQ_ID_NO: 72; RNA; Homo_Sapiens> GI\|61742781\|ref\|NM_018494.3\|<br>*Homo sapiens* leucine-rich repeats and death domain containing (LRDD), transcript variant 2, mRNA<br><SEQ_ID_NO: 73; RNA; Homo_Sapiens> GI\|61742785\|ref\|NM_145887.2\|<br>*Homo sapiens* leucine-rich repeats and death domain containing (LRDD), transcript variant 3, mRNA |
| 29 | CYBA | <SEQ_ID_NO: 74; RNA; Homo_Sapiens> GI\|68509913\|ref\|NM_000101.2\|<br>*Homo sapiens* cytochrome b-245, alpha polypeptide (CYBA), mRNA |
| 30 | ATF3 | <SEQ_ID_NO: 75; RNA; Homo_Sapiens> GI\|71902534\|ref\|NM_001674.2\|<br>*Homo sapiens* activating transcription factor 3 (ATF3), transcript variant 1, mRNA<br><SEQ_ID_NO: 76; RNA; Homo_Sapiens> GI\|95102484\|ref\|NM_001030287.2\|<br>*Homo sapiens* activating transcription factor 3 (ATF3), transcript variant 3, mRNA<br><SEQ_ID_NO: 77; RNA; Homo_Sapiens> GI\|95102482\|ref\|NM_001040619.1\|<br>*Homo sapiens* activating transcription factor 3 (ATF3), transcript variant 4, mRNA |
| 31 | HRK | <SEQ_ID_NO: 78; RNA; Homo_Sapiens> GI\|4504492\|ref\|NM_003806.1\|<br>*Homo sapiens* harakiri, BCL2 interacting protein (contains only BH3 domain) (HRK), mRNA |
| 32 | C1QBP | <SEQ_ID_NO: 79; RNA; Homo_Sapiens> GI\|28872801\|ref\|NM_001212.3\|<br>*Homo sapiens* complement component 1, q subcomponent binding protein (C1QBP), nuclear gene encoding mitochondrial protein, mRNA |
| 33 | BNIP3 | <SEQ_ID_NO: 80; RNA; Homo_Sapiens> GI\|7669480\|ref\|NM_004052.2\|<br>*Homo sapiens* BCL2/adenovirus E1B 19 kDa interacting protein 3 (BNIP3), nuclear gene encoding mitochondrial protein, mRNA |
| 34 | MAPK8 | <SEQ_ID_NO: 81; RNA; Homo_Sapiens> GI\|20986522\|ref\|NM_139049.1\|<br>*Homo sapiens* mitogen-activated protein kinase 8 (MAPK8), transcript variant 1, mRNA<br><SEQ_ID_NO: 82; RNA; Homo_Sapiens> GI\|20986493\|ref\|NM_002750.2\|<br>*Homo sapiens* mitogen-activated protein kinase 8 (MAPK8), transcript variant 2, mRNA<br><SEQ_ID_NO: 83; RNA; Homo_Sapiens> GI\|20986518\|ref\|NM_139046.1\|<br>*Homo sapiens* mitogen-activated protein kinase 8 (MAPK8), transcript variant 3, mRNA<br><SEQ_ID_NO: 84; RNA; Homo_Sapiens> GI\|20986520\|ref\|NM_139047.1\|<br>*Homo sapiens* mitogen-activated protein kinase 8 (MAPK8), transcript variant 4, mRNA |
| 35 | MAPK14 | <SEQ_ID_NO: 85; RNA; Homo_Sapiens> GI\|194578902\|ref\|NM_001315.2\|<br>*Homo sapiens* mitogen-activated protein kinase 14 (MAPK14), transcript variant 1, mRNA<br><SEQ_ID_NO: 86; RNA; Homo_Sapiens> GI\|194578900\|ref\|NM_139012.2\|<br>*Homo sapiens* mitogen-activated protein kinase 14 (MAPK14), transcript variant 2, mRNA<br><SEQ_ID_NO: 87; RNA; Homo_Sapiens> GI\|194578904\|ref\|NM_139013.2\|<br>*Homo sapiens* mitogen-activated protein kinase 14 (MAPK14), transcript variant 3, mRNA<br><SEQ_ID_NO: 88; RNA; Homo_Sapiens> GI\|194578901\|ref\|NM_139014.2\|<br>*Homo sapiens* mitogen-activated protein kinase 14 (MAPK14), transcript variant 4, mRNA |
| 36 | Rac1 | <SEQ_ID_NO: 89; RNA; Homo_Sapiens> GI\|156071503\|ref\|NM_006908.4\|<br>*Homo sapiens* ras-related C3 botulinum toxin substrate 1 (rho family, small GUP binding protein Rac1) (RAC1), transcript variant Rac1, mRNA |

TABLE A-continued mRNA of target genes for certain embodiments of the present invention

| Target gene No. | Target gene symbol | SEQ NO, Full name and GI and accession number |
|---|---|---|
| | | <SEQ_ID_NO: 90; RNA; Homo_Sapiens> GI|156071511|ref|NM_018890.3| *Homo sapiens* ras-related C3 botulinum toxin substrate 1 (rho family, small GUP binding protein Rac1) (RAC1), transcript variant Rac1b, mRNA |
| 37 | GSK3B | <SEQ_ID_NO: 91; RNA; Homo_Sapiens> GI|225903415|ref|NM_002093.3| *Homo sapiens* glycogen synthase kinase 3 beta (GSK3B), transcript variant 1, mRNA <SEQ_ID_NO: 92; RNA; Homo_Sapiens> GI|225903436|ref|NM_001146156.1| *Homo sapiens* glycogen synthase kinase 3 beta (GSK3B), transcript variant 2, mRNA |
| 38 | P2RX7 | <SEQ_ID_NO: 93; RNA; Homo_Sapiens> GI|34335273|ref|NM_002562.4| *Homo sapiens* purinergic receptor P2X, ligand-gated ion channel, 7 (P2RX7), mRNA |
| 39 | TRPM2 | <SEQ_ID_NO: 94; RNA; Homo_Sapiens> GI|67906812|ref|NM_003307.3| *Homo sapiens* transient receptor potential cation channel, subfamily M, member 2 (TRPM2), transcript variant L, mRNA |
| 40 | PARG | <SEQ_ID_NO: 95; RNA; Homo_Sapiens> GI|70610135|ref|NM_003631.2| *Homo sapiens* poly (ADP-ribose) glycohydrolase (PARG), mRNA |
| 41 | CD38 | <SEQ_ID_NO: 96; RNA; Homo_Sapiens> GI|38454325|ref|NM_001775.2| *Homo sapiens* CD38 molecule (CD38), mRNA |
| 42 | STEAP4 | <SEQ_ID_NO: 97; RNA; Homo_Sapiens> GI|100815814|ref|NM_024636.2| *Homo sapiens* STEAP family member 4 (STEAP4), mRNA |
| 43 | BMP2 | <SEQ_ID_NO: 98; RNA; Homo_Sapiens> GI|80861484|ref|NM_001200.2| *Homo sapiens* bone morphogenetic protein 2 (BMP2), mRNA |
| 44 | GJA1 | <SEQ_ID_NO: 99; RNA; Homo_Sapiens> GI|122939163|ref|NM_000165.3| *Homo sapiens* gap junction protein, alpha 1, 43 kDa (GJA1), mRNA |
| 45 | TYROBP | <SEQ_ID_NO: 100; RNA; Homo_Sapiens> GI|291045269|ref|NM_003332.3| *Homo sapiens* TYRO protein tyrosine kinase binding protein (TYROBP), transcript variant 1, mRNA <SEQ_ID_NO: 101; RNA; Homo_Sapiens> GI|291045270|ref|NM_198125.2| *Homo sapiens* TYRO protein tyrosine kinase binding protein (TYROBP), transcript variant 2, mRNA <SEQ_ID_NO: 102; RNA; Homo_Sapiens> GI|291045271|ref|NM_001173514.1| *Homo sapiens* UYRO protein tyrosine kinase binding protein (TYROBP), transcript variant 3, mRNA <SEQ_ID_NO: 103; RNA; Homo_Sapiens> GI|291045273|ref|NM_001173515.1| *Homo sapiens* UYRO protein tyrosine kinase binding protein (TYROBP), transcript variant 4, mRNA <SEQ_ID_NO: 104; RNA; Homo_Sapiens> GI|291045275|ref|NR_033390.1| *Homo sapiens* UYRO protein tyrosine kinase binding protein (TYROBP), transcript variant 5, non-coding RNA |
| 46 | CTGF | <SEQ_ID_NO: 105; RNA; Homo_Sapiens> GI|98986335|ref|NM_001901.2| *Homo sapiens* connective tissue growth factor (CTGF), mRNA |
| 47 | ANXA2 | <SEQ_ID_NO: 106; RNA; Homo_Sapiens> GI|216547999|ref|NM_001002858.2| *Homo sapiens* annexin A2 (ANXA2), transcript variant 1, mRNA <SEQ_ID_NO: 107; RNA; Homo_Sapiens> GI|50845385|ref|NM_001002857.1| *Homo sapiens* annexin A2 (ANXA2), transcript variant 2, mRNA <SEQ_ID_NO: 108; RNA; Homo_Sapiens> GI|50845389|ref|NM_004039.2| *Homo sapiens* annexin A2 (ANXA2), transcript variant 3, mRNA <SEQ_ID_NO: 109; RNA; Homo_Sapiens> GI|216547993|ref|NM_001136015.2| *Homo sapiens* annexin A2 (ANXA2), transcript variant 4, mRNA |
| 48 | RHOA | <SEQ_ID_NO: 110; RNA; Homo_Sapiens> GI: 50593005|ref|NM_001664.2| *Homo sapiens* ras homolog gene family, member A (RHOA), mRNA. |
| 49 | DUOX1 | <SEQ_ID_NO: 111; RNA; Homo_Sapiens> GI|28872749|ref|NM_017434.3| *Homo sapiens* dual oxidase 1 (DUOX1), transcript variant 1, mRNA <SEQ_ID_NO: 112; RNA; Homo_Sapiens> GI|28872750|ref|NM_175940.1| *Homo sapiens* dual oxidase 1 (DUOX1), transcript variant 2, mRNA |
| 50 | DUOX2 | <SEQ_ID_NO: 113; RNA; Homo_Sapiens> GI|132566531|ref|NM_014080.4| *Homo sapiens* dual oxidase 2 (DUOX2), mRNA |
| 51 | DDIT4 (RTP801) | <SEQ_ID_NO: 114; RNA; Homo_Sapiens> GI|56676369|ref|NM_019058.2| *Homo sapiens* DNA-damage-inducible transcript 4 (DDIT4), mRNA |
| 52 | DDIT4L (RTP801L) | <SEQ_ID_NO: 115; RNA; Homo_Sapiens> GI|34222182|ref|NM_145244.2| *Homo sapiens* DNA-damage-inducible transcript 4-like (DDIT4L), mRNA |
| 53 | NOX4 | <SEQ_ID_NO: 116; RNA; Homo_Sapiens> GI|219842344|ref|NM_016931.3| *Homo sapiens* NADPH oxidase 4 (NOX4), transcript variant 1, mRNA <SEQ_ID_NO: 117; RNA; Homo_Sapiens> GI|219842345|ref|NM_001143836.1| *Homo sapiens* NADPH oxidase 4 (NOX4), transcript variant 2, mRNA <SEQ_ID_NO: 118; RNA; Homo_Sapiens> GI|219842347|ref|NM_001143837.1| *Homo sapiens* NADPH oxidase 4 (NOX4), transcript variant 3, mRNA |
| 54 | NOX1 | <SEQ_ID_NO: 119; RNA; Homo_Sapiens> GI|148536872|ref|NM_007052.4| *Homo sapiens* NADPH oxidase 1 (NOX1), transcript variant NOH-1L, mRNA <SEQ_ID_NO: 120; RNA; Homo_Sapiens> GI|148536874|ref|NM_013955.2| *Homo sapiens* NADPH oxidase 1 (NOX1), transcript variant NOH-1Lv, mRNA |
| 55 | NOX2 (gp91pho, CYBB) | <SEQ_ID_NO: 121; RNA; Homo_Sapiens> GI|163854302|ref|NM_000397.3| *Homo sapiens* cytochrome b-245, beta polypeptide (CYBB), mRNA |
| 56 | NOX5 | <SEQ_ID_NO: 122; RNA; Homo_Sapiens> GI|20127623|ref|NM_024505.2| *Homo sapiens* NADPH oxidase, EF-hand calcium binding domain 5 (NOX5), mRNA |
| 57 | NOXO1 | <SEQ_ID_NO: 123; RNA; Homo_Sapiens> GI|34222190|ref|NM_144603.2| *Homo sapiens* NADPH oxidase organizer 1 (NOXO1), transcript variant a, mRNA <SEQ_ID_NO: 124; RNA; Homo_Sapiens> GI|41281810|ref|NM_172167.1| *Homo sapiens* NADPH oxidase organizer 1 (NOXO1), transcript variant b, mRNA |

TABLE A-continued mRNA of target genes for certain embodiments of the present invention

| Target gene No. | Target gene symbol | SEQ NO, Full name and GI and accession number |
|---|---|---|
| 58 | NCF1 | <SEQ_ID_NO: 125; RNA; Homo_Sapiens> GI|41281827|ref|NM_172168.1| *Homo sapiens* NADPH oxidase organizer 1 (NOXO1), transcript variant c, mRNA<br><SEQ_ID_NO: 126; RNA; Homo_Sapiens> GI|115298671|ref|NM_000265.4| *Homo sapiens* neutrophil cytosolic factor 1, (chronic granulomatous disease, autosomal 1) (NCF1), mRNA (also p47phox, NOXO2) |
| 59 | NOXA1 | <SEQ_ID_NO: 127; RNA; Homo_Sapiens> GI|41393186|ref|NM_006647.1| *Homo sapiens* NADPH oxidase activator 1 (NOXA1), mRNA |
| 60 | NCF2 (p67phox, NOXA2) | <SEQ_ID_NO: 128; RNA; Homo_Sapiens> GI|189083740|ref|NM_000433.3| *Homo sapiens* neutrophil cytosolic factor 2 (NCF2), transcript variant 1, mRNA<br><SEQ_ID_NO: 129; RNA; Homo_Sapiens> GI|189083741|ref|NM_001127651.1| *Homo sapiens* neutrophil cytosolic factor 2 (NCF2), transcript variant 2, mRNA |
| 61 | p53 (TP53) | <SEQ_ID_NO: 130; RNA; Homo_Sapiens> GI|187830767|ref|NM_000546.4| *Homo sapiens* tumor protein p53 (TP53), transcript variant 1, mRNA<br><SEQ_ID_NO: 131; RNA; Homo_Sapiens> GI|187830776|ref|NM_001126112.1| *Homo sapiens* tumor protein p53 (TP53), transcript variant 2, mRNA<br><SEQ_ID_NO: 132; RNA; Homo_Sapiens> GI|187830854|ref|NM_001126114.1| *Homo sapiens* tumor protein p53 (TP53), transcript variant 3, mRNA<br><SEQ_ID_NO: 133; RNA; Homo_Sapiens> GI|187830822|ref|NM_001126113.1| *Homo sapiens* tumor protein p53 (TP53), transcript variant 4, mRNA<br><SEQ_ID_NO: 134; RNA; Homo_Sapiens> GI|187830893|ref|NM_001126115.1| *Homo sapiens* tumor protein p53 (TP53), transcript variant 5, mRNA<br><SEQ_ID_NO: 135; RNA; Homo_Sapiens> GI|187830900|ref|NM_001126116.1| *Homo sapiens* tumor protein p53 (TP53), transcript variant 6, mRNA<br><SEQ_ID_NO: 136; RNA; Homo_Sapiens> GI|187830908|ref|NM_001126117.1| *Homo sapiens* tumor protein p53 (TP53), transcript variant 7, mRNA |
| 62 | HTRA2 | <SEQ_ID_NO: 137; RNA; Homo_Sapiens> GI|73747817|ref|NM_013247.4| *Homo sapiens* HtrA serine peptidase 2 (HTRA2), nuclear gene encoding mitochondrial protein, transcript variant 1, mRNA<br><SEQ_ID_NO: 138; RNA; Homo_Sapiens> GI|73747818|ref|NM_145074.2| *Homo sapiens* HtrA serine peptidase 2 (HTRA2), nuclear gene encoding mitochondrial protein, transcript variant 2, mRNA |
| 63 | KEAP1 | <SEQ_ID_NO: 139; RNA; Homo_Sapiens> GI|45269144|ref|NM_203500.1| *Homo sapiens* kelch-like ECH-associated protein 1 (KEAP1), transcript variant 1, mRNA<br><SEQ_ID_NO: 140; RNA; Homo_Sapiens> GI|45269143|ref|NM_012289.3| *Homo sapiens* kelch-like ECH-associated protein 1 (KEAP1), transcript variant 2, mRNA |
| 64 | SHC1 | <SEQ_ID_NO: 141; RNA; Homo_Sapiens> GI|194239661|ref|NM_183001.4| *Homo sapiens* SHC (Src homology 2 domain containing) transforming protein 1 (SHC1), transcript variant 1, mRNA<br><SEQ_ID_NO: 142; RNA; Homo_Sapiens> GI|194239660|ref|NM_003029.4| *Homo sapiens* SHC (Src homology 2 domain containing) transforming protein 1 (SHC1), transcript variant 2, mRNA<br><SEQ_ID_NO: 143; RNA; Homo_Sapiens> GI|194239663|ref|NM_001130040.1| *Homo sapiens* SHC (Src homology 2 domain containing) transforming protein 1 (SHC1), transcript variant 3, mRNA<br><SEQ_ID_NO: 144; RNA; Homo_Sapiens> GI|194239667|ref|NM_001130041.1| *Homo sapiens* SHC (Src homology 2 domain containing) transforming protein 1 (SHC1), transcript variant 4, mRNA |
| 65 | ZNHIT1 | <SEQ_ID_NO: 145; RNA; Homo_Sapiens> GI|37594439|ref|NM_006349.2| *Homo sapiens* zinc finger, HIT type 1 (ZNHIT1), mRNA |
| 66 | LGALS3 | <SEQ_ID_NO: 146; RNA; Homo_Sapiens> GI|294345473|ref|NM_002306.3| *Homo sapiens* lectin, galactoside-binding, soluble, 3 (LGALS3), transcript variant 1, mRNA<br><SEQ_ID_NO: 147; RNA; Homo_Sapiens> GI|294345474|ref|NM_001177388.1| *Homo sapiens* lectin, galactoside-binding, soluble, 3 (LGALS3), transcript variant 3, mRNA |
| 67 | HI95 (SESN2) | <SEQ_ID_NO: 148; RNA; Homo_Sapiens> GI|32454742|ref|NM_031459.3| *Homo sapiens* sestrin 2 (SESN2), mRNA |
| 68 | SOX9 | <SEQ_ID_NO: 149; RNA; Homo_Sapiens> GI|182765453|ref|NM_000346.3| *Homo sapiens* SRY (sex determining re<SEQ_ID_NO: X; RNA; Homo_Sapiens> GIon Y)-box 9 (SOX9), mRNA |
| 69 | ASPP1 | <SEQ_ID_NO: 150; RNA; Homo_Sapiens> GI|121114286|ref|NM_015316.2| *Homo sapiens* protein phosphatase 1, regulatory (inhibitor) subunit 13B (PPP1R13B), mRNA |
| 70 | CTSD | <SEQ_ID_NO: 151; RNA; Homo_Sapiens> GI|23110949|ref|NM_001909.3| *Homo sapiens* cathepsin D (CTSD), mRNA |
| 71 | CAPNS1 | <SEQ_ID_NO: 152; RNA; Homo_Sapiens> GI|51599152|ref|NM_001749.2| *Homo sapiens* calpain, small subunit 1 (CAPNS1), transcript variant 1, mRNA<br><SEQ_ID_NO: 153; RNA; Homo_Sapiens> GI|51599150|ref|NM_001003962.1| *Homo sapiens* calpain, small subunit 1 (CAPNS1), transcript variant 2, mRNA |
| 72 | FAS | <SEQ_ID_NO: 154; RNA; Homo_Sapiens> GI|23510419|ref|NM_000043.3| *Homo sapiens* Fas (TNF receptor superfamily, member 6) (FAS), transcript variant 1, mRNA<br><SEQ_ID_NO: 155; RNA; Homo_Sapiens> GI|23510420|ref|NM_152871.1| *Homo sapiens* Fas (TNF receptor superfamily, member 6) (FAS), transcript variant 2, mRNA<br><SEQ_ID_NO: 156; RNA; Homo_Sapiens> GI|23510422|ref|NM_152872.1| *Homo sapiens* Fas (TNF receptor superfamily, member 6) (FAS), transcript variant 3, mRNA<br><SEQ_ID_NO: 157; RNA; Homo_Sapiens> GI|253970392|ref|NR_028036.1| *Homo sapiens* Fas (TNF receptor superfamily, member 6) (FAS), transcript variant 4, non-coding RNA |

TABLE A-continued mRNA of target genes for certain embodiments of the present invention

| Target gene No. | Target gene symbol | SEQ NO, Full name and GI and accession number |
|---|---|---|
| | | <SEQ_ID_NO: 158; RNA; Homo_Sapiens> GI\|253970389\|ref\|NR_028033.1\|<br>*Homo sapiens* Fas (TNF receptor superfamily, member 6) (FAS), transcript variant 5, non-coding RNA<br><SEQ_ID_NO: 159; RNA; Homo_Sapiens> GI\|253970390\|ref\|NR_028034.1\|<br>*Homo sapiens* Fas (TNF receptor superfamily, member 6) (FAS), transcript variant 6, non-coding RNA<br><SEQ_ID_NO: 160; RNA; Homo_Sapiens> GI\|253970391\|ref\|NR_028035.1\|<br>*Homo sapiens* Fas (TNF receptor superfamily, member 6) (FAS), transcript variant 7, non-coding RNA |
| 73 | FASLG | <SEQ_ID_NO: 161; RNA; Homo_Sapiens> GI\|4557328\|ref\|NM_000639.1\|<br>*Homo sapiens* Fas ligand (TNF superfamily, member 6) (FASLG), mRNA |
| 74 | CAPN1 | <SEQ_ID_NO: 162; RNA; Homo_Sapiens> GI\|12408655\|ref\|NM_005186.2\|<br>*Homo sapiens* calpain 1, (mu/I) large subunit (CAPN1), mRNA |
| 75 | FADD | <SEQ_ID_NO: 163; RNA; Homo_Sapiens> GI\|215820647\|ref\|NM_003824.3\|<br>*Homo sapiens* Fas (TNFRSF6)-associated via death domain (FADD), mRNA |
| 76 | NGFR | <SEQ_ID_NO: 164; RNA; Homo_Sapiens> GI\|295842401\|ref\|NM_002507.3\|<br>*Homo sapiens* nerve growth factor receptor (NGFR), mRNA (also p75NTR) |
| 77 | PARK2 (parkin) | <SEQ_ID_NO: 165; RNA; Homo_Sapiens> GI\|169790968\|ref\|NM_004562.2\|<br>*Homo sapiens* Parkinson disease (autosomal recessive, juvenile) 2, parkin (PARK2), transcript variant 1, mRNA<br><SEQ_ID_NO: 166; RNA; Homo_Sapiens> GI\|169790970\|ref\|NM_013987.2\|<br>*Homo sapiens* Parkinson disease (autosomal recessive, juvenile) 2, parkin (PARK2), transcript variant 2, mRNA<br><SEQ_ID_NO: 167; RNA; Homo_Sapiens> GI\|169790972\|ref\|NM_013988.2\|<br>*Homo sapiens* Parkinson disease (autosomal recessive, juvenile) 2, parkin (PARK2), transcript variant 3, mRNA |
| 78 | HTT (huntingtin) | <SEQ_ID_NO: 168; RNA; Homo_Sapiens> GI\|90903230\|ref\|NM_002111.6\|<br>*Homo sapiens* huntingtin (HTT), mRNA |
| 79 | RTN4 (NogoA) | <SEQ_ID_NO: 169; RNA; Homo_Sapiens> GI\|47519458\|ref\|NM_020532.4\|<br>*Homo sapiens* reticulon 4 (RTN4), transcript variant 1, mRNA<br><SEQ_ID_NO: 170; RNA; Homo_Sapiens> GI\|47519507\|ref\|NM_153828.2\|<br>*Homo sapiens* reticulon 4 (RTN4), transcript variant 2, mRNA<br><SEQ_ID_NO: 171; RNA; Homo_Sapiens> GI\|47519538\|ref\|NM_007008.2\|<br>*Homo sapiens* reticulon 4 (RTN4), transcript variant 3, mRNA<br><SEQ_ID_NO: 172; RNA; Homo_Sapiens> GI\|47519489\|ref\|NM_207520.1\|<br>*Homo sapiens* reticulon 4 (RTN4), transcript variant 4, mRNA<br><SEQ_ID_NO: 173; RNA; Homo_Sapiens> GI\|47519561\|ref\|NM_207521.1\|<br>*Homo sapiens* reticulon 4 (RTN4), transcript variant 5, mRNA |
| 80 | RTN4R (NGR) | <SEQ_ID_NO: 174; RNA; Homo_Sapiens> GI\|47519383\|ref\|NM_023004.5\|<br>*Homo sapiens* reticulon 4 receptor (RTN4R), mRNA |
| 81 | MAG | <SEQ_ID_NO: 175; RNA; Homo_Sapiens> GI\|18104955\|ref\|NM_002361.2\|<br>*Homo sapiens* myelin associated glycoprotein (MAG), transcript variant 1, mRNA<br><SEQ_ID_NO: 176; RNA; Homo_Sapiens> GI\|18104956\|ref\|NM_080600.1\|<br>*Homo sapiens* myelin associated glycoprotein (MAG), transcript variant 2, mRNA |
| 82 | OMG | <SEQ_ID_NO: 177; RNA; Homo_Sapiens> GI\|226053675\|ref\|NM_002544.4\|<br>*Homo sapiens* oligodendrocyte myelin glycoprotein (OMG), mRNA |
| 83 | BCAN brevican | <SEQ_ID_NO: 178; RNA; Homo_Sapiens> GI\|38372934\|ref\|NM_021948.3\|<br>*Homo sapiens* brevican (BCAN), transcript variant 1, mRNA<br><SEQ_ID_NO: 179; RNA; Homo_Sapiens> GI\|38372930\|ref\|NM_198427.1\|<br>*Homo sapiens* brevican (BCAN), transcript variant 2, mRNA |
| 84 | NCAN neurocan | <SEQ_ID_NO: 180; RNA; Homo_Sapiens> GI\|118600982\|ref\|NM_004386.2\|<br>*Homo sapiens* neurocan (NCAN), mRNA |
| 85 | PTPRZ1 (phosphacan) | <SEQ_ID_NO: 181; RNA; Homo_Sapiens> GI\|91208427\|ref\|NM_002851.2\|<br>*Homo sapiens* protein tyrosine phosphatase, receptor-type, Z polypeptide 1 (PTPRZ1), mRNA |
| 86 | TNC tenascin C | <SEQ_ID_NO: 182; RNA; Homo_Sapiens> GI\|153946394\|ref\|NM_002160.2\|<br>*Homo sapiens* tenascin C (TNC), mRNA |
| 87 | NRP1 | <SEQ_ID_NO: 183; RNA; Homo_Sapiens> GI\|182508168\|ref\|NM_003873.5\|<br>*Homo sapiens* neuropilin 1 (NRP1), transcript variant 1, mRNA<br><SEQ_ID_NO: 184; RNA; Homo_Sapiens> GI\|182509170\|ref\|NM_001024628.2\|<br>*Homo sapiens* neuropilin 1 (NRP1), transcript variant 2, mRNA<br><SEQ_ID_NO: 185; RNA; Homo_Sapiens> GI\|182509171\|ref\|NM_001024629.2\|<br>*Homo sapiens* neuropilin 1 (NRP1), transcript variant 3, mRNA |
| 88 | NRP2 | <SEQ_ID_NO: 186; RNA; Homo_Sapiens> GI\|41872561\|ref\|NM_201266.1\|<br>*Homo sapiens* neuropilin 2 (NRP2), transcript variant 1, mRNA<br><SEQ_ID_NO: 187; RNA; Homo_Sapiens> GI\|41872532\|ref\|NM_003872.2\|<br>*Homo sapiens* neuropilin 2 (NRP2), transcript variant 2, mRNA<br><SEQ_ID_NO: 188; RNA; Homo_Sapiens> GI\|41872571\|ref\|NM_201279.1\|<br>*Homo sapiens* neuropilin 2 (NRP2), transcript variant 3, mRNA<br><SEQ_ID_NO: 189; RNA; Homo_Sapiens> GI\|41872543\|ref\|NM_018534.3\|<br>*Homo sapiens* neuropilin 2 (NRP2), transcript variant 4, mRNA<br><SEQ_ID_NO: 190; RNA; Homo_Sapiens> GI\|41872566\|ref\|NM_201267.1\|<br>*Homo sapiens* neuropilin 2 (NRP2), transcript variant 5, mRNA<br><SEQ_ID_NO: 191; RNA; Homo_Sapiens> GI\|41872556\|ref\|NM_201264.1\|<br>*Homo sapiens* neuropilin 2 (NRP2), transcript variant 6, mRNA |
| 89 | PLXNA1 | <SEQ_ID_NO: 192; RNA; Homo_Sapiens> GI\|262118281\|ref\|NM_032242.3\|<br>*Homo sapiens* plexin A1 (PLXNA1), mRNA |

TABLE A-continued mRNA of target genes for certain embodiments of the present invention

| Target gene No. | Target gene symbol | SEQ NO, Full name and GI and accession number |
|---|---|---|
| 90 | PLXNA2 | <SEQ_ID_NO: 193; RNA; Homo_Sapiens> GI\|113722115\|ref\|NM_025179.3\|<br>*Homo sapiens* plexin A2 (PLXNA2), mRNA |
| 91 | PLXNB1 | <SEQ_ID_NO: 194; RNA; Homo_Sapiens> GI\|194272178\|ref\|NM_002673.4\|<br>*Homo sapiens* plexin B1 (PLXNB1), transcript variant 1, mRNA<br><SEQ_ID_NO: 195; RNA; Homo_Sapiens> GI\|194272179\|ref\|NM_001130082.1\|<br>*Homo sapiens* plexin B1 (PLXNB1), transcript variant 2, mRNA |
| 92 | PLXNC1 | <SEQ_ID_NO: 196; RNA; Homo_Sapiens> GI\|5032222\|ref\|NM_005761.1\|<br>*Homo sapiens* plexin C1 (PLXNC1), mRNA |
| 93 | TNFRSF19 (TROY) | <SEQ_ID_NO: 197; RNA; Homo_Sapiens> GI\|23238201\|ref\|NM_018647.2\|<br>*Homo sapiens* tumor necrosis factor receptor superfamily, member 19 (TNFRSF19), transcript variant 1, mRNA<br><SEQ_ID_NO: 198; RNA; Homo_Sapiens> GI\|31652245\|ref\|NM_148957.2\|<br>*Homo sapiens* tumor necrosis factor receptor superfamily, member 19 (TNFRSF19), transcript variant 2, mRNA |
| 94 | LRRC1 | <SEQ_ID_NO: 199; RNA; Homo_Sapiens> GI\|239582716\|ref\|NM_001031692.2\|<br>*Homo sapiens* leucine rich repeat containing 17 (LRRC17), transcript variant 1, mRNA<br><SEQ_ID_NO: 200; RNA; Homo_Sapiens> GI\|239582713\|ref\|NM_005824.2\|<br>*Homo sapiens* leucine rich repeat containing 17 (LRRC17), transcript variant 2, mRNA |
| 95 | ROCK1 | 95. ROCK1—Rho-associated, coiled-coil containing protein kinase 1<br><SEQ_ID_NO: 201; RNA; Homo_Sapiens> GI\|112382209\|ref\|NM_005406.2\|<br>*Homo sapiens* Rho-associated, coiled-coil containing protein kinase 1 (ROCK1), mRNA |
| 96 | LIMK1 | <SEQ_ID_NO: 202; RNA; Homo_Sapiens> GI\|8051616\|ref\|NM_002314.2\|<br>*Homo sapiens* LIM domain kinase 1 (LIMK1), mRNA |
| 97 | LIMK2 | <SEQ_ID_NO: 203; RNA; Homo_Sapiens> GI\|73390139\|ref\|NM_001031801.1\|<br>*Homo sapiens* LIM domain kinase 2 (LIMK2), transcript variant 1, mRNA<br><SEQ_ID_NO: 204; RNA; Homo_Sapiens> GI\|73390104\|ref\|NM_005569.3\|<br>*Homo sapiens* LIM domain kinase 2 (LIMK2), transcript variant 2a, mRNA<br><SEQ_ID_NO: 205; RNA; Homo_Sapiens> GI\|73390131\|ref\|NM_016733.2\|<br>*Homo sapiens* LIM domain kinase 2 (LIMK2), transcript variant 2b, mRNA |
| 98 | CFL1 cofilin | <SEQ_ID_NO: 206; RNA; Homo_Sapiens> GI\|49472823\|ref\|NM_005507.2\|<br>*Homo sapiens* cofilin 1 (non-muscle) (CFL1), mRNA |
| 99 | KCNC4 | <SEQ_ID_NO: 207; RNA; Homo_Sapiens> GI\|88758574\|ref\|NM_004978.3\|<br>*Homo sapiens* potassium voltage-gated channel, Shaw-related subfamily, member 4 (KCNC4), transcript variant 1, mRNA<br><SEQ_ID_NO: 208; RNA; Homo_Sapiens> GI\|88758573\|ref\|NM_153763.2\|<br>*Homo sapiens* potassium voltage-gated channel, Shaw-related subfamily, member 4 (KCNC4), transcript variant 2, mRNA<br><SEQ_ID_NO: 209; RNA; Homo_Sapiens> GI\|88758575\|ref\|NM_001039574.1\|<br>*Homo sapiens* potassium voltage-gated channel, Shaw-related subfamily, member 4 (KCNC4), transcript variant 3, mRNA |
| 100 | KCNE3 | <SEQ_ID_NO: 210; RNA; Homo_Sapiens> GI\|115387116\|ref\|NM_005472.4\|<br>*Homo sapiens* potassium voltage-gated channel, Isk-related family, member 3 (KCNE3), mRNA |
| 101 | NAT8L | <SEQ_ID_NO: 211; RNA; Homo_Sapiens> GI\|263192220\|ref\|NM_178557.3\|<br>*Homo sapiens* N-acetyltransferase 8-like (GCN5-related, putative) (NAT8L), mRNA |
| 102 | FKBP1A | <SEQ_ID_NO: 212; RNA; Homo_Sapiens> GI\|206725517\|ref\|NM_054014.2\|<br>*Homo sapiens* FK506 binding protein 1A, 12 kDa (FKBP1A), transcript variant 12A, mRNA<br><SEQ_ID_NO: 213; RNA; Homo_Sapiens> GI\|206725516\|ref\|NM_000801.3\|<br>*Homo sapiens* FK506 binding protein 1A, 12 kDa (FKBP1A), transcript variant 12B, mRNA |
| 103 | FKBP4 | <SEQ_ID_NO: 214; RNA; Homo_Sapiens> GI\|206725538\|ref\|NM_002014.3\|<br>*Homo sapiens* FK506 binding protein 4, 59 kDa (FKBP4), mRNA |
| 104 | LRRK2 | <SEQ_ID_NO: 215; RNA; Homo_Sapiens> GI\|171846277\|ref\|NM_198578.3\|<br>*Homo sapiens* leucine-rich repeat kinase 2 (LRRK2), mRNA |
| 105 | DYRK1A | <SEQ_ID_NO: 216; RNA; Homo_Sapiens> GI\|116734670\|ref\|NM_001396.3\|<br>*Homo sapiens* dual-specificity tyrosine-(Y)-phosphorylation regulated kinase 1A (DYRK1A), transcript variant 1, mRNA<br><SEQ_ID_NO: 217; RNA; Homo_Sapiens> GI\|116734669\|ref\|NM_130436.2\|<br>*Homo sapiens* dual-specificity tyrosine-(Y)-phosphorylation regulated kinase 1A (DYRK1A), transcript variant 2, mRNA<br><SEQ_ID_NO: 218; RNA; Homo_Sapiens> GI\|116734671\|ref\|NM_101395.2\|<br>*Homo sapiens* dual-specificity tyrosine-(Y)-phosphorylation regulated kinase 1A (DYRK1A), transcript variant 3, mRNA<br><SEQ_ID_NO: 219; RNA; Homo_Sapiens> GI\|116734673\|ref\|NM_130438.2\|<br>*Homo sapiens* dual-specificity tyrosine-(Y)-phosphorylation regulated kinase 1A (DYRK1A), transcript variant 5, mRNA |
| 106 | AKAP13 | <SEQ_ID_NO: 220; RNA; Homo_Sapiens> GI\|31563329\|ref\|NM_006738.4\|<br>*Homo sapiens* A kinase (PRKA) anchor protein 13 (AKAP13), transcript variant 1, mRNA<br><SEQ_ID_NO: 221; RNA; Homo_Sapiens> GI\|31563331\|ref\|NM_007200.3\|<br>*Homo sapiens* A kinase (PRKA) anchor protein 13 (AKAP13), transcript variant 2, mRNA<br><SEQ_ID_NO: 222; RNA; Homo_Sapiens> GI\|31563332\|ref\|NM_144767.3\|<br>*Homo sapiens* A kinase (PRKA) anchor protein 13 (AKAP13), transcript variant 3, mRNA |
| 107 | UBE2K | <SEQ_ID_NO: 223; RNA; Homo_Sapiens> GI\|163660383\|ref\|NM_005339.4\|<br>*Homo sapiens* ubiquitin-conjugating enzyme E2K (UBC1 homolog, yeast) (UBE2K), transcript variant 1, mRNA<br><SEQ_ID_NO: 224; RNA; Homo_Sapiens> GI\|163660384\|ref\|NM_001111112.1\| |

TABLE A-continued mRNA of target genes for certain embodiments of the present invention

| Target gene No. | Target gene symbol | SEQ NO, Full name and GI and accession number |
|---|---|---|
| | | *Homo sapiens* ubiquitin-conjugating enzyme E2K (UBC1 homolog, yeast) (UBE2K), transcript variant 2, mRNA<br><SEQ_ID_NO: 225; RNA; Homo_Sapiens> GI|163660386|ref|NM_001111113.1|<br>*Homo sapiens* ubiquitin-conjugating enzyme E2K (UBC1 homolog, yeast) (UBE2K), transcript variant 3, mRNA |
| 108 | WDR33 | <SEQ_ID_NO: 226; RNA; Homo_Sapiens> GI|56243589|ref|NM_018383.3|<br>*Homo sapiens* WD repeat domain 33 (WDR33), transcript variant 1, mRNA<br><SEQ_ID_NO: 227; RNA; Homo_Sapiens> GI|55743156|ref|NM_001006622.1|<br>*Homo sapiens* WD repeat domain 33 (WDR33), transcript variant 2, mRNA<br><SEQ_ID_NO: 228; RNA; Homo_Sapiens> GI|55743158|ref|NM_001006623.1|<br>*Homo sapiens* WD repeat domain 33 (WDR33), transcript variant 3, mRNA |
| 109 | MYCBP2 | <SEQ_ID_NO: 229; RNA; Homo_Sapiens> GI|291190786|ref|NM_015057.4|<br>*Homo sapiens* MYC binding protein 2 (MYCBP2), mRNA |
| 110 | SEPHS1 | <SEQ_ID_NO: 230; RNA; Homo_Sapiens> GI|45269154|ref|NM_012247.3|<br>*Homo sapiens* selenophosphate synthetase 1 (SEPHS1), mRNA |
| 111 | HMGB1 | <SEQ_ID_NO: 231; RNA; Homo_Sapiens> GI|118918424|ref|NM_002128.4|<br>*Homo sapiens* high-mobility group box 1 (HMGB1), mRNA |
| 112 | HMGB2 | <SEQ_ID_NO: 232; RNA; Homo_Sapiens> GI|194688131|ref|NM_002129.3|<br>*Homo sapiens* high-mobility group box 2 (HMGB2), transcript variant 1, mRNA<br><SEQ_ID_NO: 233; RNA; Homo_Sapiens> GI|194688132|ref|NM_001130688.1|<br>*Homo sapiens* high-mobility group box 2 (HMGB2), transcript variant 2, mRNA<br><SEQ_ID_NO: 234; RNA; Homo_Sapiens> GI|194688134|ref|NM_001130689.1|<br>*Homo sapiens* high-mobility group box 2 (HMGB2), transcript variant 3, mRNA |
| 113 | TRPM7 | <SEQ_ID_NO: 235; RNA; Homo_Sapiens> GI|148612862|ref|NM_017672.3|<br>*Homo sapiens* transient receptor potential cation channel, subfamily M, member 7 (TRPM7), mRNA |
| 114 | BECN1 | <SEQ_ID_NO: 236; RNA; Homo_Sapiens> GI|187608304|ref|NM_003766.3|<br>*Homo sapiens* beclin 1, autophagy related (BECN1), mRNA |
| 115 | THEM4 | <SEQ_ID_NO: 237; RNA; Homo_Sapiens> GI|76159292|ref|NM_053055.3|<br>*Homo sapiens* thioesterase superfamily member 4 (THEM4), mRNA |
| 116 | SLC4A7 | <SEQ_ID_NO: 238; RNA; Homo_Sapiens> GI|134288864|ref|NM_003615.3|<br>*Homo sapiens* solute carrier family 4, sodium bicarbonate cotransporter, member 7 (SLC4A7), mRNA |
| 117 | MMP9 | <SEQ_ID_NO: 239; RNA; Homo_Sapiens> GI|74272286|ref|NM_004994.2|<br>*Homo sapiens* matrix metallopeptidase 9 (gelatinase B, 92 kDa gelatinase, 92 kDa type IV collagenase) (MMP9), mRNA |
| 118 | SLC11A2 | <SEQ_ID_NO: 240; RNA; Homo_Sapiens> GI|295293166|ref|NM_001174125.1|<br>*Homo sapiens* solute carrier family 11 (proton-coupled divalent metal ion transporters), member 2 (SLC11A2), transcript variant 1, mRNA<br><SEQ_ID_NO: 241; RNA; Homo_Sapiens> GI|295293168|ref|NM_001174126.1|<br>*Homo sapiens* solute carrier family 11 (proton-coupled divalent metal ion transporters), member 2 (SLC11A2), transcript variant 2, mRNA<br><SEQ_ID_NO: 242; RNA; Homo_Sapiens> GI|295293170|ref|NM_001174127.1|<br>*Homo sapiens* solute carrier family 11 (proton-coupled divalent metal ion transporters), member 2 (SLC11A2), transcript variant 3, mRNA<br><SEQ_ID_NO: 243; RNA; Homo_Sapiens> GI|295293174|ref|NM_001174128.1|<br>*Homo sapiens* solute carrier family 11 (proton-coupled divalent metal ion transporters), member 2 (SLC11A2), transcript variant 5, mRNA<br><SEQ_ID_NO: 244; RNA; Homo_Sapiens> GI|295293172|ref|NM_001174129.1|<br>*Homo sapiens* solute carrier family 11 (proton-coupled divalent metal ion transporters), member 2 (SLC11A2), transcript variant 6, mRNA<br><SEQ_ID_NO: 245; RNA; Homo_Sapiens> GI|295293177|ref|NM_001174130.1|<br>*Homo sapiens* solute carrier family 11 (proton-coupled divalent metal ion transporters), member 2 (SLC11A2), transcript variant 7, mRNA<br><SEQ_ID_NO: 246; RNA; Homo_Sapiens> GI|295293176|ref|NR_033421.1|<br>*Homo sapiens* solute carrier family 11 (proton-coupled divalent metal ion transporters), member 2 (SLC11A2), transcript variant 8, non-coding RNA<br><SEQ_ID_NO: 247; RNA; Homo_Sapiens> GI|295293179|ref|NR_033422.1|<br>*Homo sapiens* solute carrier family 11 (proton-coupled divalent metal ion transporters), member 2 (SLC11A2), transcript variant 9, non-coding RNA |
| 119 | ATXN3 | <SEQ_ID_NO: 248; RNA; Homo_Sapiens> GI|258613852|ref|NR_028457.1|<br>*Homo sapiens* ataxin 3 (ATXN3), transcript variant k, non-coding RNA<br><SEQ_ID_NO: 249; RNA; Homo_Sapiens> GI|258613861|ref|NR_028464.1|<br>*Homo sapiens* ataxin 3 (ATXN3), transcript variant v, non-coding RNA<br><SEQ_ID_NO: 250; RNA; Homo_Sapiens> GI|258613858|ref|NR_028462.1|<br>*Homo sapiens* ataxin 3 (ATXN3), transcript variant q, non-coding RNA<br><SEQ_ID_NO: 251; RNA; Homo_Sapiens> GI|258613866|ref|NR_028469.1|<br>*Homo sapiens* ataxin 3 (ATXN3), transcript variant af, non-coding RNA<br><SEQ_ID_NO: 252; RNA; Homo_Sapiens> GI|258614032|ref|NM_001164781.1|<br>*Homo sapiens* ataxin 3 (ATXN3), transcript variant y, mRNA<br><SEQ_ID_NO: 253; RNA; Homo_Sapiens> GI|258613860|ref|NR_028463.1|<br>*Homo sapiens* ataxin 3 (ATXN3), transcript variant t, non-coding RNA<br><SEQ_ID_NO: 254; RNA; Homo_Sapiens> GI|258614028|ref|NM_001164779.1|<br>*Homo sapiens* ataxin 3 (ATXN3), transcript variant r, mRNA<br><SEQ_ID_NO: 255; RNA; Homo_Sapiens> GI|258614024|ref|NM_001164778.1|<br>*Homo sapiens* ataxin 3 (ATXN3), transcript variant o, mRNA |

TABLE A-continued mRNA of target genes for certain embodiments of the present invention

| Target gene No. | Target gene symbol | SEQ NO, Full name and GI and accession number |
|---|---|---|
| | | <SEQ_ID_NO: 256; RNA; Homo_Sapiens> GI|258613857|ref|NR_028460.1| *Homo sapiens* ataxin 3 (ATXN3), transcript variant n, non-coding RNA |
| | | <SEQ_ID_NO: 257; RNA; Homo_Sapiens> GI|258614018|ref|NM_001164774.1| *Homo sapiens* ataxin 3 (ATXN3), transcript variant b, mRNA |
| | | <SEQ_ID_NO: 258; RNA; Homo_Sapiens> GI|258613854|ref|NR_028459.1| *Homo sapiens* ataxin 3 (ATXN3), transcript variant m, non-coding RNA |
| | | <SEQ_ID_NO: 259; RNA; Homo_Sapiens> GI|258613862|ref|NR_028465.1| *Homo sapiens* ataxin 3 (ATXN3), transcript variant w, non-coding RNA |
| | | <SEQ_ID_NO: 260; RNA; Homo_Sapiens> GI|258614037|ref|NR_028454.1| *Homo sapiens* ataxin 3 (ATXN3), transcript variant d, non-coding RNA |
| | | <SEQ_ID_NO: 261; RNA; Homo_Sapiens> GI|189163490|ref|NM_004993.5| *Homo sapiens* ataxin 3 (ATXN3), transcript variant reference, mRNA |
| | | <SEQ_ID_NO: 262; RNA; Homo_Sapiens> GI|258614026|ref|NM_001164777.1| *Homo sapiens* ataxin 3 (ATXN3), transcript variant j, mRNA |
| | | <SEQ_ID_NO: 263; RNA; Homo_Sapiens> GI|258614036|ref|NR_028453.1| *Homo sapiens* ataxin 3 (ATXN3), transcript variant a, non-coding RNA |
| | | <SEQ_ID_NO: 264; RNA; Homo_Sapiens> GI|258613853|ref|NR_028458.1| *Homo sapiens* ataxin 3 (ATXN3), transcript variant l, non-coding RNA |
| | | <SEQ_ID_NO: 265; RNA; Homo_Sapiens> GI|258613859|ref|NR_028461.1| *Homo sapiens* ataxin 3 (ATXN3), transcript variant p, non-coding RNA |
| | | <SEQ_ID_NO: 266; RNA; Homo_Sapiens> GI|258614034|ref|NM_001164782.1| *Homo sapiens* ataxin 3 (ATXN3), transcript variant ae, mRNA |
| | | <SEQ_ID_NO: 267; RNA; Homo_Sapiens> GI|258613851|ref|NR_028456.1| *Homo sapiens* ataxin 3 (ATXN3), transcript variant i, non-coding RNA |
| | | <SEQ_ID_NO: 268; RNA; Homo_Sapiens> GI|258613864|ref|NR_028467.1| *Homo sapiens* ataxin 3 (ATXN3), transcript variant z, non-coding RNA |
| | | <SEQ_ID_NO: 269; RNA; Homo_Sapiens> GI|258613998|ref|NM_001127697.2| *Homo sapiens* ataxin 3 (ATXN3), transcript variant e, mRNA |
| | | <SEQ_ID_NO: 270; RNA; Homo_Sapiens> GI|258613865|ref|NR_028468.1| *Homo sapiens* ataxin 3 (ATXN3), transcript variant ac, non-coding RNA |
| | | <SEQ_ID_NO: 271; RNA; Homo_Sapiens> GI|258614038|ref|NR_028455.1| *Homo sapiens* ataxin 3 (ATXN3), transcript variant f, non-coding RNA |
| | | <SEQ_ID_NO: 272; RNA; Homo_Sapiens> GI|258614022|ref|NM_001164776.1| *Homo sapiens* ataxin 3 (ATXN3), transcript variant g, mRNA |
| | | <SEQ_ID_NO: 273; RNA; Homo_Sapiens> GI|258614030|ref|NM_001164780.1| *Homo sapiens* ataxin 3 (ATXN3), transcript variant u, mRNA |
| | | <SEQ_ID_NO: 274; RNA; Homo_Sapiens> GI|269995997|ref|NR_031765.1| *Homo sapiens* ataxin 3 (ATXN3), transcript variant c, non-coding RNA |
| | | <SEQ_ID_NO: 275; RNA; Homo_Sapiens> GI|258613863|ref|NR_028466.1| *Homo sapiens* ataxin 3 (ATXN3), transcript variant x, non-coding RNA |
| | | <SEQ_ID_NO: 276; RNA; Homo_Sapiens> GI|189163492|ref|NM_001127696.1| *Homo sapiens* ataxin 3 (ATXN3), transcript variant ad, mRNA |
| | | <SEQ_ID_NO: 277; RNA; Homo_Sapiens> GI|189163491|ref|NM_030660.4| *Homo sapiens* ataxin 3 (ATXN3), transcript variant h, mRNA |
| | | <SEQ_ID_NO: 278; RNA; Homo_Sapiens> GI|258613867|ref|NR_028470.1| *Homo sapiens* ataxin 3 (ATXN3), transcript variant am, non-coding RNA |
| 120 | ATXN1 | <SEQ_ID_NO: 279; RNA; Homo_Sapiens> GI|189491747|ref|NM_001128164.1| *Homo sapiens* ataxin 1 (ATXN1), transcript variant 2, mRNA |
| | | <SEQ_ID_NO: 280; RNA; Homo_Sapiens> GI|189491746|ref|NM_000332.3| *Homo sapiens* ataxin 1 (ATXN1), transcript variant 1, mRNA |
| 121 | ATXN7 | <SEQ_ID_NO: 281; RNA; Homo_Sapiens> GI|293651610|ref|NM_001128149.2| *Homo sapiens* ataxin 7 (ATXN7), transcript variant SCA7c, mRNA |
| | | <SEQ_ID_NO: 282; RNA; Homo_Sapiens> GI|293651612|ref|NM_001177387.1| *Homo sapiens* ataxin 7 (AUXN7), transcript variant SCA7b, mRNA |
| | | <SEQ_ID_NO: 283; RNA; Homo_Sapiens> GI|189491740|ref|NM_000333.3| *Homo sapiens* ataxin 7 (ATXN7), transcript variant SCA7a, mRNA |
| 123 | PRNP | <SEQ_ID_NO: 284; RNA; Homo_Sapiens> GI|122056620|ref|NM_000311.3| *Homo sapiens* prion protein (PRNP), transcript variant 1, mRNA |
| | | <SEQ_ID_NO: 285; RNA; Homo_Sapiens> GI|122056621|ref|NM_183079.2| *Homo sapiens* prion protein (PRNP), transcript variant 2, mRNA |
| | | <SEQ_ID_NO: 286; RNA; Homo_Sapiens> GI|122056622|ref|NM_001080121.1| *Homo sapiens* prion protein (PRNP), transcript variant 3, mRNA |
| | | <SEQ_ID_NO: 287; RNA; Homo_Sapiens> GI|122056624|ref|NM_001080122.1| *Homo sapiens* prion protein (PRNP), transcript variant 4, mRNA |
| | | <SEQ_ID_NO: 288; RNA; Homo_Sapiens> GI|122056627|ref|NM_001080123.1| *Homo sapiens* prion protein (PRNP), transcript variant 5, mRNA |
| 123 | EFNB3 | <SEQ_ID_NO: 289; RNA; Homo_Sapiens> GI|38201712|ref|NM_001406.3| *Homo sapiens* ephrin-B3 (EFNB3), mRNA |
| 124 | EPHA4 | <SEQ_ID_NO: 290; RNA; Homo_Sapiens> GI|45439363|ref|NM_004438.3| *Homo sapiens* EPH receptor A4 (EPHA4), mRNA |
| 125 | EFNA5 | <SEQ_ID_NO: 291; RNA; Homo_Sapiens> GI|194097333|ref|NM_001962.2| *Homo sapiens* ephrin-A5 (EFNA5), mRNA |
| 126 | EPHA7 | <SEQ_ID_NO: 292; RNA; Homo_Sapiens> GI|205277372|ref|NM_004440.3| *Homo sapiens* EPH receptor A7 (EPHA7), mRNA |

TABLE A-continued mRNA of target genes for certain embodiments of the present invention

| Target gene No. | Target gene symbol | SEQ NO, Full name and GI and accession number |
|---|---|---|
| 127 | EFNB2 | <SEQ_ID_NO: 293; RNA; Homo_Sapiens> GI|33359689|ref|NM_004093.2| *Homo sapiens* ephrin-B2 (EFNB2), mRNA |

Table A provides the gi (GeneInfo identifier) and accession numbers for an example of polynucleotide sequences of human mRNA to which the oligonucleotide inhibitors of some of the embodiments of the present invention are directed.

In various embodiments, inhibition of any one of the genes in Table A is useful in treating and attenuating disease, disorder or injury of the CNS.

The 19-mer, 20-mer and 21-mer sense and antisense oligonucleotides useful in the synthesis of double stranded RNA compounds that are utilized in the present invention are selected according to a proprietary algorithm or according to algorithms known in the art.

In further embodiments, the present invention relates to use of otic pharmaceutical compositions according to the present invention and to methods for the treatment of a subject in need of treatment for a disease, a disorder, or a symptom or a condition associated with the disease or disorder, associated with the expression of a gene selected from the group consisting of SEQ ID NOS:1-293 comprising administering to the ear of the subject an otic pharmaceutical composition comprising at least one double stranded RNA which reduces or inhibits expression of the gene selected. In a preferred embodiment the subject is a human subject. In preferred embodiments the double stranded RNA compound is chemically modified according to the embodiments of the present invention.

Otic pharmaceutical composition of the invention is useful with any oligonucleotide pair (sense and antisense strands) to a mammalian gene or non-mammalian gene.

Without being bound by theory, oligonucleotide compounds administered to the brain, spinal cord and retina according to the non-invasive methods disclosed reach target tissues and cells in the CNS via three different pathways:
1. Reaching the endolymph of the membranous labyrinth of the inner ear. The endolymph is connected to perilymph, which surrounds the endolymphatic compartment. The perilymph is connected fairly directly to cerebral spinal fluid (CSF) pathways via the cochlear canaliculus. Through the CSF the oligonucleotide compound reaches other regions of the CNS (axons are usually protected from their environment by a thin layer of CSF, cerebral ventricals are filled with CSF).
2. Reaching small veins and capillaries. However, oligonucleotide compounds will have to pass through the BBB (or, in case of the retina, through the blood-retinal barrier) and only very small amounts of oligonucleotide compounds reaches the CNS through the blood circulation
3. Entering the neurons of the vestibulocochlear nerve. From there the oligonucleotide compound passes through different nerve tracts of the CNS and is delivered to either the retina (via de medial geniculate body (that is common to both the optic nerve tract and the vestibulo cochlear tract and from there to the optic tract) or to different cortical regions (via, for example, the following tract: the cochlear nucleus→superior olivary nucleus→inferior colliculus→medial geniculate nucleus→auditory cortex).

DEFINITIONS

For convenience certain terms employed in the specification, examples and claims are described herein.

It is to be noted that, as used herein, the singular forms "a", "an" and "the" include plural forms unless the content clearly dictates otherwise.

Where aspects or embodiments of the invention are described in terms of Markush groups or other grouping of alternatives, those skilled in the art will recognize that the invention is also thereby described in terms of any individual member or subgroup of members of the group.

An "inhibitor" is a compound, which is capable of reducing (partially or fully) the expression of a gene or the activity of the product of such gene to an extent sufficient to achieve a desired biological or physiological effect. The term "inhibitor" as used herein refers to a siRNA inhibitor.

A "double stranded RNA inhibitor" is a compound, which is capable of reducing the expression of a gene or the activity of the product of such gene to an extent sufficient to achieve a desired biological or physiological effect. The term as used herein refers to one or more of a siRNA, shRNA, and synthetic shRNA. Inhibition may also be referred to as down-regulation or, for RNAi, silencing.

The term "inhibit" as used herein refers to reducing the expression of a gene or the activity of the product of such gene to an extent sufficient to achieve a desired biological or physiological effect. Inhibition is either complete or partial. For example "inhibition" of APP gene means inhibition of the gene expression (transcription or translation) or polypeptide activity of one or more of the variants or an SNP (single nucleotide polymorphism) thereof.

"Central nervous system" or "CNS" means the brain, optic nerve, retina and/or spinal cord.

As used herein, "central nervous system disorder" or "CNS disorder" or "disease of the central nervous system" or "disease of the CNS" means any condition or disease that causes or results in a functional and/or physical deficit in the brain, retina, optic nerve and/or spinal cord or in the cells and tissues which comprise the brain, retina, optic nerve and/or spinal cord.

The term "injury of the central nervous system" or "injury of the CNS" refers to any and all injury or trauma of the brain, retina, optic nerve and/or spinal cord, including traumatic and non-traumatic injury, that causes or results in an impairment of motor and/or sensory and/or cognitive and/or mental and/or emotional and/or autonomic function.

As used herein, the term "neuroprotection" means the arrest and/or slow down and/or attenuate and/or reverse progression of neurodegeneration. As used herein, the term "neurodegeneration" means the progressive loss of neurons. This includes but is not limited to immediate loss of neurons followed by subsequent loss of connecting or adjacent neurons.

"Neuron," "neuronal cell" and "neural cell" (including neural progenitor cells and neural stem cells) are used interchangeably to refer to nerve cells, i.e., cells that are responsible for conducting nerve impulses from one part of the body to another. Most neurons consist of three distinct portions: a cell body which contains the nucleus, and two different types of cytoplasmic processes: dendrites and axons. Dendrites, which are the receiving portion of the neuron, are usually highly branched, thick extensions of the cell body. The axon is typically a single long, thin process that is specialized to conducts nerve impulses away from the cell body to another neuron or muscular or glandular tissue. Axons may have side branches called "axon collaterals." Axon collaterals and axons may terminate by branching into many fine filaments called telodendria. The distal ends of telodendria are called synaptic end bulbs or axonal terminals, which contain synaptic vesicles that store neurotransmitters. Axons may be surrounded by a multilayered, white, phospholipid, segmented covering called the myelin sheath, which is formed by Schwann cells in the peripheral nervous system and oligodendrocytes in the central nervous system. Axons containing such a covering are "myelinated." Neurons include sensory (afferent) neurons, which transmit impulses from receptors in the periphery to the brain and spinal cord and from lower to higher centers of the central nervous system. A neuron can also be motor (efferent) neurons which convey impulses from the brain and spinal cord to effectors in the periphery and from higher to lower centers of the central nervous system. Other neurons are association (connecting or interneuron) neurons which carry impulses from sensory neurons to motor neurons and are located within the central nervous system. The processes of afferent and efferent neurons arranged into bundles are called "nerves" when located outside the CNS or fiber tracts if inside the CNS.

The term "topical administration" or "topical application" is used to mean a local administration of an otic composition to the ear of the subject.

The term "otic" and "auricular" are used herein interchangeably and generally refer to tissue in and/or around an ear, including the outer ear, the middle ear and the inner ear.

The term "ear canal" or "external auditory meatus" is used to mean a tube running from the outer ear to the middle ear.

The "tympanic membrane" (also tympanum or myrinx) refers to a thin membrane that separates the external ear from the middle ear.

Terms such as "pharmaceutical composition" or "otic pharmaceutical composition" or "pharmaceutical formulation" or "otic pharmaceutical formulation" or "pharmaceutical preparation" or "otic pharmaceutical preparation" are used herein interchangebly to generally refer to formulations that are adapted to otic administration and delivery of one or more oligonucleotide active compounds to a CNS, a CNS cell, a group of CNS cells, or a CNS tissue, in an animal or a human.

"Treatment," "treat," or "treating," as used herein covers any treatment of a disease or condition of a mammal, particularly a human, and includes: (a) preventing the disease or condition from occurring in a subject which may be predisposed to the disease or condition but has not yet been diagnosed as having it; (b) inhibiting the disease or condition, i.e., arresting or slowing down or postponing its development or progression; (c) relieving and/or ameliorating the disease or condition, i.e., causing regression of the disease or condition and/or the symptoms thereof; or (d) curing the disease or condition, i.e., stopping its development or progression. The population of subjects treated by the methods of the invention includes subjects suffering from the undesirable condition or disease, as well as subjects at risk for development of the condition or disease.

As used herein, the term "pharmaceutically acceptable" means that the components, in addition to the therapeutic agent, comprising the formulation, are suitable for administration to the patient being treated in accordance with the present invention.

A "penetration enhancer" or "permeability enhancer" refers to a compound or a combination of compounds that enhance the penetration of a therapeutic oligonucleotide through the skin and/or the tympanic membrane in the ear of an animal or a human.

As used herein, the term "tissue" refers to an aggregation of similarly specialized cells united in the performance of a particular function.

"CNS cells" includes one or more of neuronal cells and/or glial cells (e.g. oligodendrocytes, astrocytes, ependymal cells, microglial cells, radial glia cells, or Schwann cells) and include the optic nerve and cells of the retina.

As used herein, the terms "polynucleotide" and "nucleic acid" may be used interchangeably and refer to nucleotide sequences comprising deoxyribonucleic acid (DNA), and ribonucleic acid (RNA). The terms are to be understood to include, as equivalents, analogs of either RNA or DNA made from nucleotide analogs. Throughout this application, mRNA sequences are set forth as representing the corresponding genes.

"Oligonucleotide" and "oligomer" are used interchangeably and refer to a deoxyribonucleotide or ribonucleotide sequence from about 2 to about 50 nucleotides. Each DNA or RNA nucleotide may be independently natural or synthetic, and or modified or unmodified. Modifications include changes to the sugar moiety, the base moiety and or the linkages between nucleotides in the oligonucleotide. The compounds of the present invention encompass molecules comprising deoxyribonucleotides, ribonucleotides, modified deoxyribonucleotides, modified ribonucleotides, unconventional moieties and combinations thereof. Oligonucleotide is meant to encompass single stranded molecules including antisense and shRNA, and double stranded molecules including double stranded RNA (dsRNA), siNA, siRNA and miRNA.

Substantially complementary refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary. Accordingly substantially identical refers to identity of greater than about 84%, to another sequence.

The present invention provides methods and compositions for inhibiting expression of a target gene in vivo. In general, the method includes topical otic administration of oligoribonucleotides, in particular double stranded RNA compounds (e.g. small interfering RNAs or siRNAs) or a nucleic acid material that can produce siRNA in a cell, to target an mRNA of the genes set forth in Table A; in an amount sufficient to down-regulate expression of a target gene by an RNA interference mechanism. In particular, the method can be used to inhibit expression of the gene for treatment of a subject suffering from a disease, disorder or injury related to expression of that gene in CNS tissue or cell. In accordance with the present invention, the double stranded RNA molecules or inhibitors of the target gene are used as drugs to treat various CNS pathologies.

"Nucleotide" is meant to encompass deoxyribonucleotides and ribonucleotides, which may be natural or synthetic, and or modified or unmodified. Modifications include changes to the sugar moiety, the base moiety and or the linkages between ribonucleotides in the oligoribonucleotide. As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide.

The nucleotides can be selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thiolalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine. In some embodiments one or more nucleotides in an oligomer is substituted with inosine.

In some embodiments of the present invention the inhibitory oligonucleotide compound comprises unmodified and modified nucleotides and/or unconventional moieties. The compound comprises at least one modified nucleotide selected from the group consisting of a sugar modification, a base modification and an internucleotide linkage modification and may contain DNA, and modified nucleotides such as LNA (locked nucleic acid), ENA (ethylene-bridged nucleic acid), PNA (peptide nucleic acid), arabinoside, phosphonocarboxylate or phosphinocarboxylate nucleotide (PACE nucleotide), mirror nucleotide, or nucleotides with a 6 carbon sugar.

All analogs of, or modifications to, a nucleotide/oligonucleotide are employed with the present invention, provided that said analog or modification does not substantially adversely affect the function of the nucleotide/oligonucleotide. Acceptable modifications include modifications of the sugar moiety, modifications of the base moiety, modifications in the internucleotide linkages and combinations thereof.

A sugar modification includes a modification on the 2' moiety of the sugar residue and encompasses amino, fluoro, alkoxy e.g. methoxy, alkyl, amino, fluoro, chloro, bromo, CN, CF, imidazole, carboxylate, thioate, $C_1$ to $C_{10}$ lower alkyl, substituted lower alkyl, alkaryl or aralkyl, $OCF_3$, OCN; O-, S-, or N-alkyl; O-, S, or N-alkenyl; $SOCH_3$; $SO_2CH_3$; $ONO_2$; $NO_2$, $N_3$; heterocycloalkyl; heterocycloalkaryl; aminoalkylamino; polyalkylamino or substituted silyl, as, among others, described in European patents EP 0 586 520 B1 or EP 0 618 925 B1.

In one embodiment the double stranded RNA compound comprises at least one ribonucleotide comprising a 2' modification on the sugar moiety ("2' sugar modification"). In certain embodiments the compound comprises 2'O-alkyl or 2'-fluoro or 2'O-allyl or any other 2' modification, optionally on alternate positions. Other stabilizing modifications are also possible (e.g. terminal modifications). In some embodiments a preferred 2'O-alkyl is 2'O-methyl (methoxy) sugar modification.

In some embodiments the backbone of the oligonucleotides is modified and comprises phosphate-D-ribose entities but may also contain thiophosphate-D-ribose entities, triester, thioate, 2'-5' bridged backbone (also may be referred to as 5'-2'), PACE and the like.

As used herein, the terms "non-pairing nucleotide analog" means a nucleotide analog which comprises a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide. In addition, analogues of polynucleotides may be prepared wherein the structure of one or more nucleotide is fundamentally altered and better suited as therapeutic or experimental reagents. An example of a nucleotide analogue is a peptide nucleic acid (PNA) wherein the deoxyribose (or ribose) phosphate backbone in DNA (or RNA) is replaced with a polyamide backbone which is similar to that found in peptides. PNA analogues have been shown to be resistant to enzymatic degradation and to have enhanced stability in vivo and in vitro. Other modifications useful in synthesizing oligonucleotides include polymer backbones, cyclic backbones, acyclic backbones, thiophosphate-D-ribose backbones, triester backbones, thioate backbones, 2'-5' linked backbone (also lmown as 2'5' nucleotides, or 2'5' ribonucleotides [with 3'OH]), artificial nucleic acids, morpholino nucleic acids, glycol nucleic acid (GNA), threose nucleic acid (TNA), arabinoside, and mirror nucleoside (for example, beta-L-deoxyribonucleoside instead of beta-D-deoxyribonucleoside). Examples of siRNA compounds comprising LNA nucleotides are disclosed in Elmen et al., (NAR 2005, 33(1):439-447).

In some embodiments the double stranded RNA compounds are synthesized using one or more inverted nucleotides, for example inverted thymidine or inverted adenine (see, for example, Takei, et al., 2002, JBC 277(26):23800-06).

Other modifications include terminal modifications on the 5' and/or 3' part of the oligonucleotides and are also known as capping moieties. Such terminal modifications are selected from a nucleotide, a modified nucleotide, a lipid, a peptide, a sugar and inverted abasic moiety.

What is sometimes referred to in the present invention as an "abasic nucleotide" or "abasic nucleotide analog" is more properly referred to as a pseudo-nucleotide or an unconventional moiety. A nucleotide is a monomeric unit of nucleic acid, consisting of a ribose or deoxyribose sugar, a phosphate, and a base (adenine, guanine, thymine, or cytosine in DNA; adenine, guanine, uracil, or cytosine in RNA). A modified nucleotide comprises a modification in one or more of the sugar, phosphate and or base. The abasic pseudo-nucleotide lacks a base, and thus is not strictly a nucleotide.

The term "capping moiety" as used herein ("z'"") includes abasic ribose moiety, abasic deoxyribose moiety, modified abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'O-Me nucleotide; and nucleotide analogs including 4',5'-methylene nucleotide; 1-(β-D-erythrofuranosyl) nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Certain preferred capping moieties are abasic ribose or abasic deoxyribose moieties; inverted abasic ribose or abasic deoxyribose moieties; C6-amino-Pi; a mirror nucleotide including L-DNA and L-RNA. Another preferred capping moiety is a C3 non-nucleotide moiety derived from propanediol The term "unconventional moiety" as used herein refers to abasic ribose moiety, an abasic deoxyribose moiety, a deoxyribonucleotide, a modified deoxyribonucleotide, a mirror nucleotide, a non-base pairing nucleotide analog and a nucleotide linked to an adjacent nucleotide by a 2'-5' internucleotide phosphate bond; bridged nucleic acids including LNA and ethylene bridged nucleic acids.

In some embodiments of the present invention a preferred unconventional moiety is an abasic ribose moiety, an abasic deoxyribose moiety, a deoxyribonucleotide, a mirror nucleotide, and a nucleotide linked to an adjacent nucleotide by a 2'-5' internucleotide phosphate bond.

Abasic deoxyribose moiety includes for example abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moiety includes inverted deoxyriboabasic; 3',5' inverted deoxyabasic 5'-phosphate.

A "mirror nucleotide" is a nucleotide with reversed chirality to the naturally occurring or commonly employed nucleotide, i.e., a mirror image (L-nucleotide) of the naturally occurring (D-nucleotide), also referred to as L-RNA in the case of a mirror ribonucleotide, and "spiegelmer". The nucleotide can be a ribonucleotide or a deoxyribonucleotide and my further comprise at least one sugar, base and or backbone modification. See U.S. Pat. No. 6,586,238. Also, U.S. Pat. No. 6,602,858 discloses nucleic acid catalysts comprising at least one L-nucleotide substitution. Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror rU).

Modified deoxyribonucleotide includes, for example 5' OMe DNA (5-methyl-deoxyriboguanosine-3'-phosphate) which may be useful as a nucleotide in the 5' terminal position (position number 1); PACE (deoxyriboadenine 3' phosphonoacetate, deoxyribocytidine 3' phosphonoacetate, deoxyriboguanosine 3' phosphonoacetate, deoxyribothymidine 3' phosphonoacetate).

Bridged nucleic acids include LNA (2'-O,4'-C-methylene bridged Nucleic Acid adenosine 3' monophosphate, 2'-O,4'-C-methylene bridged Nucleic Acid 5-methyl-cytidine 3' monophosphate, 2'-O,4'-C-methylene bridged Nucleic Acid guano sine 3' monophosphate, 5-methyl-uridine (or thymidine) 3' monophosphate); and ENA (2'-O,4'-C-ethylene bridged Nucleic Acid adenosine 3' monophosphate, 2'-O,4'-C-ethylene bridged Nucleic Acid 5-methyl-cytidine 3' monophosphate, 2'-O,4'-C-ethylene bridged Nucleic Acid guanosine 3' monophosphate, 5-methyl-uridine (or thymidine) 3' monophosphate). According to one aspect the present invention provides inhibitory oligonucleotide compounds comprising unmodified and modified nucleotides. The compound comprises at least one modified nucleotide selected from the group consisting of a sugar modification, a base modification and an internucleotide linkage modification and may contain DNA, and modified nucleotides such as LNA (locked nucleic acid) including ENA (ethylene-bridged nucleic acid); PNA (peptide nucleic acid); arabinoside; PACE (phosphonoacetate and derivatives thereof), mirror nucleotide, or nucleotides with a six-carbon sugar.

siRNA and RNA Interference

A number of PCT applications have recently been published that relate to the RNAi phenomenon. These include: PCT publication WO 00/44895; PCT publication WO 00/49035; PCT publication WO 00/63364; PCT publication WO 01/36641; PCT publication WO 01/36646; PCT publication WO 99/32619; PCT publication WO 00/44914; PCT publication WO 01/29058; and PCT publication WO 01/75164.

RNA interference (RNAi) is based on the ability of dsRNA species to enter a cytoplasmic protein complex, where it is then targeted to the complementary cellular RNA and specifically degrade it. The RNA interference response features an endonuclease complex containing a siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir et al., Genes Dev., 2001, 15(2): 188-200). In more detail, longer dsRNAs are digested into short (17-29 bp) dsRNA fragments (also referred to as short inhibitory RNAs, "siRNAs") by type III RNAses (DICER, DROSHA, etc.; Bernstein et al., Nature, 2001, 409(6818): 363-6; Lee et al., Nature, 2003, 425(6956):415-9). The RISC protein complex recognizes these fragments and complementary mRNA. The whole process is culminated by endonuclease cleavage of target mRNA (McManus & Sharp, Nature Rev Genet, 2002, 3(10):737-47; Paddison & Hannon, Curr Opin Mol Ther. 2003, 5(3):217-24). (For additional information on these terms and proposed mechanisms, see for example Bernstein et al., RNA 2001, 7(11):1509-21; Nishikura, Cell 2001, 107(4):415-8 and PCT publication WO 01/36646).

The selection and synthesis of siRNA corresponding to known genes has been widely reported; see for example Ui-Tei et al., J Biomed Biotechnol. 2006; 2006: 65052; Chalk et al., BBRC. 2004, 319(1): 264-74; Sioud & Leirdal, Met. Mol Biol.; 2004, 252:457-69; Levenkova et al., Bioinform. 2004, 20(3):430-2; Ui-Tei et al., Nuc. Acid Res. 2004, 32(3):936-48. For examples of the use of, and production of, modified siRNA see Braasch et al., Biochem., 2003, 42(26):7967-75; Chiu et al., RNA, 2003, 9(9):1034-48; PCT publications WO 2004/015107 (Atugen); WO 02/44321 (Tuschl et al), and U.S. Pat. Nos. 5,898,031 and 6,107,094.

A siRNA is a double-stranded RNA (dsRNA) which downregulates or silences (i.e. fully or partially inhibits) the expression of an endogenous or exogenous gene/mRNA. RNA interference is based on the ability of certain dsRNA species to enter a specific protein complex, where they are then targeted to complementary cellular RNA (i.e. mRNA), which they specifically degrade or cleave. Thus, the RNA interference response features an endonuclease complex containing siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir, et al., Genes Dev., 2001, 15:188). In more detail, longer dsRNAs are digested into short (17-29 bp) dsRNA fragments (also referred to as short inhibitory RNAs or "siRNAs") by type III RNAses (DICER, DROSHA, etc., see Bernstein et al., Nature, 2001, 409:363-6 and Lee et al., Nature, 2003, 425:415-9). The RISC protein complex recognizes these fragments and complementary mRNA. The whole process is culminated by endonuclease cleavage of target mRNA (McManus and Sharp, Nature Rev Genet, 2002, 3:737-47; Paddison and Hannon, Curr Opin Mol Ther. 2003, 5(3): 217-24). For additional information on these terms and proposed mechanisms, see for example, Bernstein, et al., RNA. 2001, 7(11):1509-21; Nishikura, Cell. 2001, 107(4): 415-8 and PCT Publication No. WO 01/36646.

Studies have revealed that siRNA can be effective in vivo in mammals including humans. Specifically, Bitko et al., showed that specific siRNAs directed against the respiratory syncytial virus (RSV) nucleocapsid N gene are effective in treating mice when administered intranasally (Nat. Med. 2005, 11(1):50-55). For reviews of therapeutic applications of siRNAs see for example Barik (Mol. Med 2005, 83: 764-773) and Chakraborty (Current Drug Targets 2007 8(3):469-82). In addition, clinical studies with short siRNAs that target the VEGF receptor 1 (VEGFR1) to treat age-related macular degeneration (AMD) have been conducted in human patients (Kaiser, Am J Ophthalmol. 2006 142(4):660-8). Further information on the use of siRNA as therapeutic agents is found in Durcan, 2008. Mol. Pharma. 5(4):559-566; Kim and Rossi, 2008. BioTechniques 44:613-616; Grimm and Kay, 2007, JCI, 117(12):3633-41.

Chemically Modified Double Stranded RNA Compounds

The selection and synthesis of siRNA corresponding to known genes has been widely reported; (see for example Ui-Tei et al., 2006. J Biomed Biotechnol. 2006:65052; Chalk et al., 2004. BBRC. 319(1): 264-74; Sioud & Leirdal, 2004. Met. Mol Biol. 252:457-69; Levenkova et al., 2004, Bioinform. 20(3):430-2; Ui-Tei et al., 2004. NAR 32(3):936-48).

Examples for the use of, and production of, modified siRNA are found in Braasch et al., 2003. Biochem., 42(26): 7967-75; Chiu et al., 2003, RNA, 9(9):1034-48; PCT publications WO 2004/015107 (atugen AG) and WO 02/44321 (Tuschl et al). U.S. Pat. Nos. 5,898,031 and 6,107,094 teach chemically modified oligomers. U.S. Pat. No. 7,452,987 relates to oligomeric compounds having alternating unmodified and 2' sugar modified ribonucleotides. US patent publication No. 2005/0042647 describes dsRNA compounds having chemically modified internucleoside linkages.

Amarzguioui et al., (2003, NAR, 31(2):589-595) showed that siRNA activity depended on the positioning of the 2'-O-methyl modifications. Holen et al (2003, NAR, 31(9):2401-2407) report that an siRNA having small numbers of 2'-O-methyl modified nucleosides showed good activity compared to wild type but that the activity decreased as the numbers of 2'-O-methyl modified nucleosides was increased. Chiu and Rana (2003, RNA, 9:1034-1048) teach that incorporation of 2'-O-methyl modified nucleosides in the sense or antisense strand (fully modified strands) severely reduced siRNA activity relative to unmodified siRNA. The placement of a 2'-O-methyl group at the 5'-terminus on the antisense strand was reported to severely limit activity whereas placement at the 3'-terminus of the antisense and at both termini of the sense strand was tolerated (Czauderna et al., 2003, NAR, 31(11), 2705-2716). PCT Patent Application Nos. PCT/IL2008/000248 and PCT/IL2008/001197, assigned to the assignee of the present invention, and hereby incorporated by reference in their entirety, disclose motifs useful in the preparation of chemically modified siRNA compounds.

Double Stranded RNA Oligonucleotides

Otic pharmaceutical compositions of the invention are prepared using any chemically modified or non-modified double stranded RNA oligonucleotide compound. siRNA which are Dicer substrates or asymmetric siRNA may be used with the invention. Double stranded RNA oligonucleotide compounds used in the present invention encompass any pharmaceutically acceptable salts, esters, or salts of such esters, or any other compound which, upon administration to an mammal, including a human, is capable of treating diseases, disorders and injury of the CNS. The term "pharmaceutically acceptable salts" refers to physiologically and pharmaceutically acceptable salts, i.e., salts that retain the desired biological activity of the parent compound and do not impart undesired toxicological effects thereto. In some embodiments otic pharmaceutical compositions of the invention are prepared using double stranded RNA compounds that are chemically and or structurally modified according to one of the following modifications set forth in Structures disclosed herein or as tandem siRNA or RNAstar (see below).

Throughout the specification, nucleotide positions are numbered from 1 to 19 or 1 to 21 or 1 to 23 and are counted from the 5' end of the antisense or sense oligonucleotides. For example, position 1 on (N)x refers to the 5' terminal nucleotide on the antisense oligonucleotide strand and position 1 on (N')y refers to the 5' terminal nucleotide on the sense oligonucleotide strand.

In one aspect the present invention provides an otic pharmaceutical composition comprising a therapeutically effective amount of a double stranded RNA molecule set forth as Structure (A):

(A)  5'  $(N)_x$-Z 3' (antisense strand)

3' Z'-$(N')_y$-z" 5' (sense strand)

wherein each of N and N' is a nucleotide which may be unmodified or modified, or an unconventional moiety;
wherein each of $(N)_x$ and $(N')_y$ is an oligonucleotide in which each consecutive N or N' is joined to the next N or N' by a covalent bond;
wherein each of x and y is an integer between 18 and 40;
wherein each of Z and Z' may be present or absent, but if present is 1-5 consecutive nucleotides or non-nucleotide moieties covalently attached at the 3' terminus of the strand in which it is present;
wherein z" may be present or absent, but if present is a capping moiety covalently attached at the 5' terminus of (N') y;
each of x and y is independently an integer from 18 to 40;
wherein the sequence of (N')y has complementary to the sequence of (N)x; and wherein (N)x includes an antisense sequence to mRNA of a gene upregulated in a disease, disorder or injury of the CNS.

In some embodiments (N)x comprises an antisense that is complementary to about 18 to about 40 consecutive ribonucleotides in a target mRNA set forth in any one of SEQ ID NOS:1-293.

In some embodiments (N)x and (N')y are oligonucleotide pairs provided in PCT Patent Publication Nos. WO 2006/023544, WO 2007/084684, WO 2008/050329, WO 2007/141796, WO 2009/044392, WO 2008/106102, WO 2008/152636, WO 2009/001359, WO/2009/090639 assigned to the assignee of the present invention and incorporated herein by reference in their entirety.

In some embodiments the covalent bond joining each consecutive N or N' is a phosphodiester bond.

In some embodiments x=y and each of x and y is 19, 20, 21, 22 or 23. In various embodiments x=y=19. In some embodiments the antisense and sense strands form a duplex by base pairing In some embodiments Z and Z' are absent. In other embodiments one of Z or Z' is present.

In some embodiments the 5' terminal nucleotide of the antisense strand (position 1 of the antisense strand) is mismatched to the target mRNA. In some embodiments the 5' terminal nucleotide of the antisense strand is a modified riboadenosine or a modified ribouridine.

In some embodiments each of $(N)_x$ and $(N')_y$ is independently phosphorylated or non-phosphorylated at the 3' and 5' termini.

In certain embodiments wherein each of x and y=19, each N at the 5' and 3' termini of $(N)_x$ is modified; and each N' at the 5' and 3' termini of $(N')_y$ is unmodified.

In certain embodiments wherein each of x and y=21, each N at the 5' and 3' termini of $(N)_x$ is unmodified; and each N' at the 5' and 3' termini of $(N')_y$ is modified.

In particular embodiments, x and y=19, and the double stranded RNA compound is modified such that a 2'OMe sugar modified ribonucleotide (2'OMe) is present in nuclease snestive positions. In some embodiments at least one pyrimidine comprises a 2'OMe sugar modification. In some embodiments all pyrimidines comprise a 2'OMe sugar modification. In some embodiments 2'OMe sugar modified ribonucleotides are present in the first, third, fifth, seventh, ninth, eleventh, thirteenth, fifteenth, seventeenth and nineteenth positions of the antisense strand $(N)_x$, and a 2'-OMe sugar modified ribonucleotide is present in the second, fourth, sixth, eighth, tenth, twelfth, fourteenth, sixteenth and eighteenth positions of the sense strand $(N')_y$.

In some embodiments in (N)x the nucleotides are unmodified or (N)x comprises alternating 2'OMe sugar modified ribonucleotides and unmodified ribonucleotides; and the ribonucleotide located at the middle position of (N)x being modified or unmodified preferably unmodified. In some embodiments (N')y comprises unmodified ribonucleotides further comprising one modified nucleotide at a terminal or penultimate position, wherein the modified nucleotide is selected from the group consisting of a mirror nucleotide, a bicyclic nucleotide, a 2'-sugar modified nucleotide, an altritol nucleotide, or a nucleotide joined to an adjacent nucleotide by an internucleotide linkage selected from a 2'-5' phosphodiester bond, a P-alkoxy linkage or a PACE linkage;

In particular embodiments, x=y=19 and in (N)x each modified ribonucleotide is a 2'OMe sugar modified ribonucleotide and the ribonucleotide located at the middle of (N)x is unmodified. Accordingly, in a compound wherein x=19, (N)x comprises 2'OMe sugar modified ribonucleotides at positions 1, 3, 5, 7, 9, 11, 13, 15, 17 and 19. In other embodiments, (N)x comprises 2'OMe sugar modified ribonucleotides at positions 2, 4, 6, 8, 11, 13, 15, 17 and 19 and may further comprise at least one abasic or inverted abasic unconventional moiety for example in position 5. In other embodiments, (N)x comprises 2'OMe sugar modified ribonucleotides at positions 2, 4, 8, 11, 13, 15, 17 and 19 and may further comprise at least one abasic or inverted abasic unconventional moiety for example in position 6. In other embodiments, (N)x comprises 2'OMe sugar modified ribonucleotides at positions 2, 4, 6, 8, 11, 13, 17 and 19 and may further comprise at least one abasic or inverted abasic unconventional moiety for example in position 15. In other embodiments, (N)x comprises 2'OMe sugar modified ribonucleotides at positions 2, 4, 6, 8, 11, 13, 15, 17 and 19 and may further comprise at least one abasic or inverted abasic unconventional moiety for example in position 14. In other embodiments, (N)x comprises 2'OMe sugar modified ribonucleotides at positions 1, 2, 3, 7, 9, 11, 13, 15, 17 and 19 and may further comprise at least one abasic or inverted abasic unconventional moiety for example in position 5. In other embodiments, (N)x comprises 2'O Memodified ribonucleotides at positions 1, 2, 3, 5, 7, 9, 11, 13, 15, 17 and 19 and may further comprise at least one abasic or inverted abasic unconventional moiety for example in position 6. In other embodiments, (N)x comprises 2'OMe sugar modified ribonucleotides at positions 1, 2, 3, 5, 7, 9, 11, 13, 17 and 19 and may further comprise at least one abasic or inverted abasic unconventional moiety for example in position 15. In other embodiments, (N)x comprises 2'OMe sugar modified ribonucleotides at positions 1, 2, 3, 5, 7, 9, 11, 13, 15, 17 and 19 and may further comprise at least one abasic or inverted abasic unconventional moiety for example in position 14. In other embodiments, (N)x comprises 2'OMe sugar modified ribonucleotides at positions 2, 4, 6, 7, 9, 11, 13, 15, 17 and 19 and may further comprise at least one abasic or inverted abasic unconventional moiety for example in position 5. In other embodiments, (N)x comprises 2'OMe sugar modified ribonucleotides at positions 1, 2, 4, 6, 7, 9, 11, 13, 15, 17 and 19 and may further comprise at least one abasic or inverted abasic unconventional moiety for example in position 5. In other embodiments, (N)x comprises 2'OMe sugar modified ribonucleotides at positions 2, 4, 6, 8, 11, 13, 14, 16, 17 and 19 and may further comprise at least one abasic or inverted abasic unconventional moiety for example in position 15. In other embodiments, (N)x comprises 2'OMe sugar modified ribonucleotides at positions 1, 2, 3, 5, 7, 9, 11, 13, 14, 16, 17 and 19 and may further comprise at least one abasic or inverted abasic unconventional moiety for example in position 15. In other embodiments, (N)x comprises 2'OMe sugar modified ribonucleotides at positions 2, 4, 6, 8, 11, 13, 15, 17 and 19 and may further comprise at least one abasic or inverted abasic unconventional moiety for example in position 7. In other embodiments, (N)x comprises 2'O-Me modified ribonucleotides at positions 2, 4, 6, 11, 13, 15, 17 and 19 and may further comprise at least one abasic or inverted abasic unconventional moiety for example in position 8. In other embodiments, (N)x comprises 2'OMe sugar modified ribonucleotides at positions 2, 4, 6, 8, 11, 13, 15, 17 and 19 and may further comprise at least one abasic or inverted abasic unconventional moiety for example in position 9. In other embodiments, (N)x comprises 2'OMe sugar modified ribonucleotides at positions 2, 4, 6, 8, 11, 13, 15, 17 and 19 and may further comprise at least one abasic or inverted abasic unconventional moiety for example in position 10. In other embodiments, (N)x comprises 2'OMe sugar modified ribonucleotides at positions 2, 4, 6, 8, 13, 15, 17 and 19 and may further comprise at least one abasic or inverted abasic unconventional moiety for example in position 11. In other embodiments, (N)x comprises 2'OMe sugar modified ribonucleotides at positions 2, 4, 6, 8, 11, 13, 15, 17 and 19 and may further comprise at least one abasic or inverted abasic unconventional moiety for example in position 12. In other embodiments, (N)x comprises 2'O-Me modified ribonucleotides at positions 2, 4, 6, 8, 11, 15, 17 and 19 and may further comprise at least one abasic or inverted abasic unconventional moiety for example in position 13.

In yet other embodiments (N)x comprises at least one nucleotide mismatch relative to the target mRNA. In certain preferred embodiments, (N)x comprises a single nucleotide mismatch in position 1, relative to the target RNA. In one embodiment at least two nucleotides at either or both the 5' and 3' termini of (N')y are joined by a 2'-5' phosphodiester bond. In certain preferred embodiments x=y=19; in (N)x the nucleotides alternate between 2'OMe sugar modified ribonucleotides and unmodified ribonucleotides, and the ribonucleotide located at the middle of (N)x being unmodified; and three nucleotides at the 3' terminus of (N')y are joined by two 2'-5' phosphodiester bonds. In other preferred embodiments, x=y=19; in (N)x the nucleotides alternate between 2'OMe sugar modified ribonucleotides and unmodified ribonucleotides, and the ribonucleotide located at the middle of (N)x being unmodified; and four consecutive nucleotides at the 5' terminus of (N')y are joined by three 2'-5' phosphodiester bonds. In a further embodiment, an additional nucleotide located in the middle position of (N)y is a 2'OMe sugar modified ribonucleotide. In another preferred embodiment, in (N)x the nucleotides alternate between 2'OMe sugar modified ribonucleotides and unmodified ribonucleotides, and in (N')y four consecutive nucleotides at the 5' terminus are joined by three 2'-5' phosphodiester bonds and the 5' terminal nucleotide or two or three consecutive nucleotides at the 5' terminus comprise 3'-O-methyl (3'OMe) modifications.

In certain preferred embodiments, x=y=19 and in (N')y, at least one position comprises an abasic or inverted abasic unconventional moiety, preferably five positions comprises an abasic or inverted abasic unconventional moieties. In various embodiments, the following positions comprise an abasic or inverted abasic: positions 1 and 16-19, positions 15-19, positions 1-2 and 17-19, positions 1-3 and 18-19, positions 1-4 and 19 and positions 1-5. (N')y may further comprise at least one LNA nucleotide.

In certain preferred embodiments, x=y=19 and in (N')y the nucleotide in at least one position comprises a mirror nucleotide, a deoxyribonucleotide and a nucleotide joined to an adjacent nucleotide by a 2'-5' internucleotide bond.

In certain preferred embodiments, x=y=19 and (N')y comprises a mirror nucleotide. In various embodiments the mirror nucleotide is an L-DNA nucleotide. In certain embodiments the L-DNA is L-deoxyribocytidine. In some embodiments (N')y comprises L-DNA at position 18. In other embodiments (N')y comprises L-DNA at positions 17 and 18. In certain embodiments (N')y comprises L-DNA substitutions at positions 2 and at one or both of positions 17 and 18. In certain embodiments (N')y further comprises a 5' terminal cap nucleotide such as 5'-O-methyl DNA or an abasic or inverted abasic moiety as an overhang.

In yet other embodiments (N')y comprises a DNA at position 15 and L-DNA at one or both of positions 17 and 18. In that structure, position 2 may further comprise an L-DNA or an abasic unconventional moiety.

Other embodiments are envisaged wherein x=y=21 in these embodiments the modifications for (N')y discussed above instead of being on positions 15, 16, 17, 18 are on positions 17, 18, 19, 20 for 21-mer.; similarly the modifications at one or both of positions 17 and 18 are on one or both of positions 19 or 20 for a 21-mer oligonucleotide. All modifications in the 19-mer oligonucleotide are similarly adjusted for the 21- and 23-mer oligonucleotides.

According to various embodiments in (N')y 2, 3, 4, 5, 6, 7 or 8 consecutive ribonucleotides at the 3' terminus are linked by 2'-5' internucleotide linkages. In one preferred embodiment, four consecutive nucleotides at the 3' terminus of (N')y are joined by three 2'-5' phosphodiester bonds, wherein one or more of the 2'-5' nucleotides which form the 2'-5' phosphodiester bonds further comprises a 3'-O-methyl sugar modification. Preferably the 3' terminal nucleotide of (N')y is a 2'OMe sugar modified ribonucleotide. In certain preferred embodiments of Structure C, x=y=19 and in (N')y two or more consecutive nucleotides at positions 15, 16, 17, 18 and 19 comprise a nucleotide joined to an adjacent nucleotide by a 2'-5' internucleotide bond. In various embodiments the nucleotide forming the 2'-5' internucleotide bond comprises a 3' deoxyribose nucleotide or a 3' methoxy nucleotide. In some embodiments the nucleotides at positions 17 and 18 in (N')y are joined by a 2'-5' internucleotide bond. In other embodiments the nucleotides at positions 16-17, 17-18, or 16-18 in (N')y are joined by a 2'-5' internucleotide bond.

In certain embodiments (N')y comprises an L-DNA at position 2 and 2'-5' internucleotide bonds at positions 16-17, 17-18, or 16-18. In certain embodiments (N')y comprises 2'-5' internucleotide bonds at positions 16-17, 17-18, or 16-18 and a 5' terminal cap nucleotide.

According to various embodiments, in (N')y 2, 3, 4, 5, 6, 7, 8, 9, 10, 11, 12, 13 or 14 consecutive nucleotides at either terminus or 2-8 modified nucleotides at each of the 5' and 3' termini are independently mirror nucleotides. In some embodiments the mirror nucleotide is an L-ribonucleotide. In other embodiments the mirror nucleotide is an L-deoxyribonucleotide. The mirror nucleotide may further be modified at the sugar or base moiety or in an internucleotide linkage.

In one preferred embodiment the 3' terminal nucleotide or two or three consecutive nucleotides at the 3' terminus of (N')y are L-deoxyribonucleotides.

In other embodiments, in (N')y 2, 3, 4, 5, 6, 7, 8, 9, 10, 11, 12, 13 or 14 consecutive ribonucleotides at either terminus or 2-8 modified nucleotides at each of the 5' and 3' termini are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe). In one series of preferred embodiments, three, four or five consecutive nucleotides at the 5' terminus of (N')y comprise the 2'-OMe modification. In another preferred embodiment, three consecutive nucleotides at the 3' terminus of (N')y are 2'OMe sugar modified ribonucleotides.

In some embodiments in (N')y 2, 3, 4, 5, 6, 7, 8, 9, 10, 11, 12, 13 or 14 consecutive ribonucleotides at either or 2-8 modified nucleotides at each of the 5' and 3' termini are independently bicyclic nucleotides. In various embodiments the bicyclic nucleotide is a locked nucleic acid (LNA) or a species of LNA, e.g. 2'-O, 4'-C-ethylene-bridged nucleic acid (ENA) is a species of LNA.

In various embodiments (N')y comprises modified nucleotides at the 5' terminus or at both the 3' and 5' termini.

In some embodiments at least two nucleotides at either or both the 5' and 3' termini of (N')y are joined by P-ethoxy backbone modifications. In certain preferred embodiments x=y=19; in (N)x the nucleotides alternate between 2'OMe sugar modified ribonucleotides and unmodified ribonucleotides, and the ribonucleotide located at the middle position of (N)x being unmodified; and four consecutive nucleotides at the 3' terminus or at the 5' terminus of (N')y are joined by three P-ethoxy backbone modifications. In another preferred embodiment, three consecutive nucleotides at the 3' terminus or at the 5' terminus of (N')y are joined by two P-ethoxy backbone modifications.

In some embodiments in (N')y 2, 3, 4, 5, 6, 7 or 8, consecutive ribonucleotides at each of the 5' and 3' termini are independently mirror nucleotides, nucleotides joined by 2'-5' phosphodiester bond, 2' sugar modified nucleotides or bicyclic nucleotide. In one embodiment, the modification at the 5' and 3' termini of (N')y is identical. In one preferred embodiment, four consecutive nucleotides at the 5' terminus of (N')y are joined by three 2'-5' phosphodiester bonds and three consecutive nucleotides at the 3' terminus of (N')y are joined by two 2'-5' phosphodiester bonds. In another embodiment, the modification at the 5' terminus of (N')y is different from the modification at the 3' terminus of (N')y. In one specific embodiment, the modified nucleotides at the 5' terminus of (N')y are mirror nucleotides and the modified nucleotides at the 3' terminus of (N')y are joined by 2'-5' phosphodiester bond. In another specific embodiment, three consecutive nucleotides at the 5' terminus of (N')y are LNA nucleotides and three consecutive nucleotides at the 3' terminus of (N')y are joined by two 2'-5' phosphodiester bonds. In (N)x the nucleotides alternate between 2'OMe sugar modified ribonucleotides and unmodified ribonucleotides, and the ribonucleotide located at the middle of (N)x being unmodified, or the ribonucleotides in (N)x being unmodified.

In another embodiment, the present invention provides a compound wherein x=y=19; in (N)x the nucleotides alternate between 2'OMe sugar modified ribonucleotides and unmodified ribonucleotides, and the ribonucleotide located at the middle of (N)x being unmodified; three nucleotides at the 3' terminus of (N')y are joined by two 2'-5' phosphodiester bonds and three nucleotides at the 5' terminus of (N')y are LNA such as ENA.

In another embodiment, five consecutive nucleotides at the 5' terminus of (N')y comprise the 2'OMe sugar modification and two consecutive nucleotides at the 3' terminus of (N')y are L-DNA.

In yet another embodiment, the present invention provides a compound wherein x=y=19; (N)x consists of unmodified ribonucleotides; three consecutive nucleotides at the 3' terminus of (N')y are joined by two 2'-5' phosphodiester bonds and three consecutive nucleotides at the 5' terminus of (N')y are LNA such as ENA.

According to other embodiments, in (N')y the 5' or 3' terminal nucleotide, or 2, 3, 4, 5 or 6 consecutive nucleotides at either termini or 1-4 modified nucleotides at each of the 5' and 3' termini are independently phosphonocarboxylate or phosphinocarboxylate nucleotides (PACE nucleotides). In some embodiments the PACE nucleotides are deoxyribonucleotides. In some preferred embodiments in (N')y, 1 or 2 consecutive nucleotides at each of the 5' and 3' termini are PACE nucleotides.

In one embodiment, x=y=19; (N)x comprises unmodified ribonucleotides in which two consecutive nucleotides linked by one 2'-5' internucleotide linkage at the 3' terminus; and (N')y comprises unmodified ribonucleotides in which two consecutive nucleotides are linked by one 2'-5' internucleotide linkage at the 5' terminus.

In some embodiments, x=y=19 or x=y=23; (N)x comprises unmodified ribonucleotides in which three consecutive nucleotides at the 3' terminus are joined together by two 2'-5' phosphodiester bonds; and (N')y comprises unmodified ribonucleotides in which four consecutive nucleotides at the 5' terminus are joined together by three 2'-5' phosphodiester bonds.

According to various embodiments 2, 3, 4, 5, 6, 7, consecutive ribonucleotides starting at the ultimate or penultimate position of the 3' terminus of (N)x and 2, 3, 4, 5, 6, 7, consecutive ribonucleotides starting at the ultimate or penultimate position of the 5' terminus of (N')y are linked by 2'-5' internucleotide linkages.

According to another embodiment, four consecutive nucleotides at the 5' terminus of (N')y are joined by three 2'-5' phosphodiester bonds and three consecutive nucleotides at the 3' terminus of (N)x are joined by two 2'-5' phosphodiester bonds. Three nucleotides at the 5' terminus of (N')y and two nucleotides at the 3' terminus of (N)x may also comprise 3'-O-methyl modifications.

According to various embodiments, 2, 3, 4, consecutive nucleotides starting at the ultimate or penultimate position of the 3' terminus of (N)x and 2, 3, 4 consecutive ribonucleotides starting at the ultimate or penultimate position of the 5' terminus of (N')y are independently mirror nucleotides. In some embodiments the mirror is an L-ribonucleotide. In other embodiments the mirror nucleotide is L-deoxyribonucleotide.

In other embodiments 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently 2' sugar modified nucleotides. In some embodiments the 2' sugar modification comprises an amino, a fluoro, an alkoxy or an alkyl moiety. In certain embodiments the 2' sugar modification comprises a methoxy moiety (2'-OMe).

In one preferred embodiment, five consecutive nucleotides at the 5' terminus of (N')y comprise the 2'OMe modification and five consecutive nucleotides at the 3' terminus of (N')x comprise the 2'OMe modification. In another preferred embodiment five to ten consecutive nucleotides at the 5' terminus of (N')y comprise the 2'OMe modification and five consecutive nucleotides at the 3' terminus of (N')x comprise the 2'OMe modification. In another preferred embodiment, thirteen consecutive nucleotides at the 5' terminus of (N')y comprise the 2'OMe modification and five consecutive nucleotides at the 3' terminus of (N')x comprise the 2'OMe modification.

In some embodiments, 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments, (N')y comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In various embodiments, (N)x comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In some embodiments wherein each of the 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In one specific embodiment, five consecutive nucleotides at the 5' terminus of (N')y comprise the 2'OMe modification and two consecutive nucleotides at the 3' terminus of (N')y are L-DNA. In addition, the compound may further comprise five consecutive 2'OMe sugar modified nucleotides at the 3' terminus of (N')x.

In various embodiments, the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

According to various embodiments, 2, 3, or 4 consecutive ribonucleotides starting at the ultimate or penultimate position of the 5' terminus of (N)x, preferably starting at the 5' penultimate position, and 2, 3, 4, 5, or 6, consecutive ribonucleotides starting at the ultimate or penultimate position of the 3' terminus of (N')y are linked by 2'-5' internucleotide linkages.

According to various embodiments, 2, 3, or 4 consecutive nucleotides starting at the ultimate or penultimate position of the 5' terminus of (N)x, preferably starting at the 5' penultimate position, and 2, 3, 4, 5, or 6 consecutive nucleotides starting at the ultimate or penultimate position of the 3' terminus of (N')y are independently mirror nucleotides. In some embodiments the mirror is an L-ribonucleotide. In other embodiments the mirror nucleotide is L-deoxyribonucleotide.

In other embodiments 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently 2' sugar modified nucleotides. In some embodiments the 2' sugar modification comprises an amino, a fluoro, an alkoxy or an alkyl moiety. In certain embodiments the 2' sugar modification comprises a methoxy moiety (2'-OMe).

In some embodiments 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments (N')y comprises modified nucleotides selected from a bicyclic nucleotide, a 2' sugar modified nucleotide, a mirror nucleotide, an altritol nucleotide, a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In various embodiments (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where both 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments, the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides. In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments, the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In other embodiments, 2, 3, 4, 5, 6, 7, 8, 9, 10, 11, 12, 13 or 14 consecutive ribonucleotides independently beginning at the ultimate or penultimate position of the 5' termini of (N)x and (N')y are independently 2' sugar modified nucleotides. In some embodiments the 2' sugar modification comprises an amino, a fluoro, an alkoxy or an alkyl moiety. In certain embodiments the 2' sugar modification comprises a methoxy moiety (2'-OMe). In some preferred embodiments the consecutive modified nucleotides preferably begin at the penultimate position of the 5' terminus of (N)x.

In one preferred embodiment, five consecutive ribonucleotides at the 5' terminus of (N')y comprise a 2'OMe modification and one ribonucleotide at the 5' penultimate position of (N')x comprises a 2'OMe modification. In another preferred embodiment, five consecutive ribonucleotides at the 5' terminus of (N')y comprise a 2'OMe modification and two consecutive ribonucleotides at the 5' terminal position of (N')x comprise a 2'OMe modification.

In various embodiments, (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In various embodiments, (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond. In various embodiments, the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In another embodiment, 2, 3, 4, 5, 6, 7, 8, 9, 10, 11, 12, 13 or 14 consecutive ribonucleotides independently beginning at the ultimate or penultimate position of the 3' terminus or the 5' terminus or 2-8 consecutive nucleotides at each of 5' and 3' termini of (N')y are independently 2' sugar modified nucleotides, bicyclic nucleotides, mirror nucleotides, altritol nucleotides or nucleotides joined to an adjacent nucleotide by a 2'-5' phosphodiester bond, and 2, 3, 4, 5, 6, 7, 8, 9, 10, 11, 12, 13 or 14 consecutive internal ribonucleotides in (N)x are independently 2' sugar modified nucleotides, bicyclic nucleotides, mirror nucleotides, altritol nucleotides or nucleotides joined to an adjacent nucleotide by a 2'-5' phosphodiester bond.

In one embodiment wherein each of 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments, the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages.

For all the above structures, in various embodiments x=y and each of x and y is and integer selected from the group consisting of 19, 20, 21, 22 and 23. In certain embodiments, x=y=19. In other embodiments x=y=21. In additional embodiments the compounds of the invention comprise modified ribonucleotides in alternating positions wherein each N at the 5' and 3' termini of (N)x is modified in its sugar residue and the middle ribonucleotide is not modified, e.g. ribonucleotide in position 10 in a 19-mer strand, position 11 in a 21-mer and position 12 in a 23-mer strand.

In some embodiments where x=y=21 or x=y=23 the position of modifications in the 19-mer are adjusted for a 21- or 23-mer oligonucleotide with the proviso that the middle nucleotide of the antisense strand is preferably not modified.

In some embodiments, neither (N)x nor (N')y are phosphorylated at the 3' and 5' termini. In other embodiments either or both (N)x and (N')y are phosphorylated at the 3' termini. In yet another embodiment, either or both (N)x and (N')y are phosphorylated at the 3' termini using non-cleavable phosphate groups. In yet another embodiment, either or both (N)x and (N')y are phosphorylated at the terminal 5' termini position using cleavable or non-cleavable phosphate groups. In some embodiments the double stranded RNA compounds are blunt ended and are non-phosphorylated at the termini; however, comparative experiments have shown that double stranded RNA compounds phosphorylated at one or both of the 3'-termini have similar activity in vivo compared to the non-phosphorylated compounds.

In certain embodiments for all the above-mentioned Structures, the double stranded RNA compound is blunt ended, for example wherein both Z and Z' are absent. In an alternative embodiment, the compound comprises at least one 3' overhang, wherein at least one of Z or Z' is present. Z and Z' independently comprises one or more covalently linked modified or non-modified nucleotides, for example inverted dT or dA; dT, LNA, mirror nucleotide and the like. In some embodiments each of Z and Z' are independently selected from dT and dTdT. Double stranded RNA in which Z and/or Z' is present have similar activity and stability as double stranded RNA in which Z and Z' are absent.

In certain embodiments for all the above-mentioned Structures, the double stranded RNA compound comprises one or more phosphonocarboxylate and/or phosphinocarboxylate nucleotides (PACE nucleotides). In some embodiments the PACE nucleotides are deoxyribonucleotides and the phosphinocarboxylate nucleotides are phosphinoacetate nucleotides.

In certain embodiments for all the above-mentioned Structures, the siRNA compound comprises one or more locked nucleic acids (LNA) also defined as bridged nucleic acids or bicyclic nucleotides. Preferred locked nucleic acids are 2'-O, 4'-C-ethylene nucleosides (ENA) or 2'-O, 4'-C-methylene nucleosides. Other examples of LNA and ENA nucleotides are disclosed in WO 98/39352, WO 00/47599 and WO 99/14226, all incorporated herein by reference.

In certain embodiments for all the above-mentioned Structures, the compound comprises one or more altritol monomers (nucleotides), also defined as 1,5 anhydro-2-deoxy-D-altrito-hexitol (see for example, Allart, et al., 1998. Nucleosides & Nucleotides 17:1523-1526; Herdewijn et al., 1999. Nucleosides & Nucleotides 18:1371-1376; Fisher et al., 2007, NAR 35(4):1064-1074; all incorporated herein by reference).

The present invention explicitly excludes compounds in which each of N and/or N' is a deoxyribonucleotide (d-A, d-C, d-G, d-T). In certain embodiments (N)x and (N')y may comprise independently 1, 2, 3, 4, 5, 6, 7, 8, 9 or more deoxyribonucleotides. In certain embodiments the present invention provides a compound wherein each of N is an unmodified ribonucleotide and the 3' terminal nucleotide or 2, 3, 4, 5, 6, 7, 8, 9, 10, 11, 12, 13 or 14 consecutive nucleotides at the 3' terminus of (N')y are deoxyribonucleotides. In yet other embodiments each of N is an unmodified ribonucleotide and the 5' terminal nucleotide or 2, 3, 4, 5, 6, 7, 8, 9, 10, 11, 12, 13 or 14 consecutive nucleotides at the 5' terminus of (N')y are deoxyribonucleotides. In further embodiments the 5' terminal nucleotide or 2, 3, 4, 5, 6, 7, 8, or 9 consecutive nucleotides at the 5' terminus and 1, 2, 3, 4, 5, or 6 consecutive nucleotides at the 3' termini of (N)x are deoxyribonucleotides and each of N' is an unmodified ribonucleotide. In yet further embodiments (N)x comprises unmodified ribonucleotides and 1 or 2, 3 or 4 consecutive deoxyribonucleotides independently at each of the 5' and 3' termini and 1 or 2, 3, 4, 5 or 6 consecutive deoxyribonucleotides in internal positions; and each of N' is an unmodified ribonucleotide. In certain embodiments the 3' terminal nucleotide or 2, 3, 4, 5, 6, 7, 8, 9, 10, 11, 12 13 or 14 consecutive nucleotides at the 3' terminus of (N')y and the terminal 5' nucleotide or 2, 3, 4, 5, 6, 7, 8, 9, 10, 11, 12 13 or 14 consecutive nucleotides at the 5' terminus of (N)x are deoxyribonucleotides. The present invention excludes compounds in which each of N and/or N' is a deoxyribonucleotide. In some embodiments the 5' terminal nucleotide of N or 2 or 3 consecutive of N and 1, 2, or 3 of N' is a deoxyribonucleotide. Certain examples of active DNA/RNA siRNA chimeras are disclosed in US patent publication 2005/

0004064, and Ui-Tei, 2008 (NAR 36(7):2136-2151) incorporated herein by reference in their entirety.

Unless otherwise indicated, in preferred embodiments of the structures discussed herein the covalent bond between each consecutive N and N' is a phosphodiester bond.

A covalent bond refers to an internucleotide linkage linking one nucleotide monomer to an adjacent nucleotide monomer. A covalent bond includes for example, a phosphodiester bond, a phosphorothioate bond, a P-alkoxy bond, a P-carboxy bond and the like. The normal internucleoside linkage of RNA and DNA is a 3' to 5' phosphodiester linkage. In certain preferred embodiments a covalent bond is a phosphodiester bond. Covalent bond encompasses non-phosphorous-containing internucleoside linkages, such as those disclosed in WO 2004/041924 inter alia. Unless otherwise indicated, in preferred embodiments of the structures discussed herein the covalent bond between each consecutive N and N' is a phosphodiester bond.

For all of the structures above, in some embodiments the oligonucleotide sequence of (N)x is fully complementary to the oligonucleotide sequence of (N')y. In other embodiments (N)x and (N')y are substantially complementary. In certain embodiments (N)x is fully complementary to 18-40 consecutive nucleotides in a target mRNA. In other embodiments (N)x is substantially complementary to 18-40 consecutive nucleotides in a target mRNA.

In some embodiments, neither (N)x nor (N')y are phosphorylated at the 3' and 5' termini. In other embodiments either or both (N)x and (N')y are phosphorylated at the 3' termini (3' Pi). In yet another embodiment, either or both (N)x and (N')y are phosphorylated at the 3' termini with non-cleavable phosphate groups. In yet another embodiment, either or both (N)x and (N')y are phosphorylated at the terminal 2' termini position using cleavable or non-cleavable phosphate groups. Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

In certain embodiments the present invention provides an otic pharmaceutical composition comprising a therapeutically effective amount of an oligonucleotide compound comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, in some embodiments the present invention provides an otic pharmaceutical composition comprising a therapeutically effective amount of an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar. Such structures are disclosed in PCT patent publication WO 2007/091269, assigned to the assignee of the present invention and incorporated herein in its entirety by reference.

Said triple-stranded oligonucleotide may be an oligoribonucleotide having the general structure:

| 5' | Oligo1 (sense) | LINKER A | Oligo2 (sense) | 3' |
|----|----------------|----------|----------------|----|
| 3' | Oligo1 (antisense) | LINKER B | Oligo3 (sense) | 5' |
| 3' | Oligo3 (antisense) | LINKER C | Oligo2 (antisense) | 5' |
| Or | | | | |
| 5' | Oligo1 (sense) | LINKER A | Oligo2 (antisense) | 3' |
| 3' | Oligo1 (antisense) | LINKER B | Oligo3 (sense) | 5' |
| 3' | Oligo3 (antisense) | LINKER C | Oligo2 (sense) | 5' |
| or | | | | |
| 5' | Oligo1 (sense) | LINKER A | Oligo3 antisense) | 3' |
| 3' | Oligo1 (antisense) | LINKER B | Oligo2 (sense) | 5' |
| 5' | Oligo3 (sense) | LINKER C | Oligo2 (antisense) | 3' | wherein one or more of linker A, linker B or linker C is present; any combination of two or more oligonucleotides and one or more of linkers A-C is possible, so long as the polarity of the strands and the general structure of the molecule remains. Further, if two or more of linkers A-C are present, they may be identical or different.

Thus, a triple-armed structure is formed, wherein each arm comprises a sense strand and complementary antisense strand (i.e. Oligo1 antisense base pairs to Oligo1 sense etc.). The triple armed structure may be triple stranded, whereby each arm possesses base pairing.

Further, the above triple stranded structure may have a gap instead of a linker in one or more of the strands. Such a molecule with one gap is technically quadruple stranded and not triple stranded; inserting additional gaps or nicks will lead to the molecule having additional strands. In certain embodiments said gapped molecules are more active in inhibiting the target gene than the similar but non-gapped molecules.

In some embodiments the present invention provides an otic pharmaceutical composition comprising a therapeutically effective amount of an oligonucleotide comprising an antisense and a sense strand, wherein neither antisense nor sense strands of said oligonucleotide compound are phosphorylated at the 3' and 5' termini. In other embodiments either or both antisense and sense strands are phosphorylated at the 3' termini. In yet another embodiment, either or both antisense and sense strands are phosphorylated at the 3' termini using non-cleavable phosphate groups. In yet another embodiment, either or both antisense and sense strands are phosphorylated at the terminal 5' termini position using cleavable or non-cleavable phosphate groups. In yet another embodiment, either or both antisense and sense strands are phosphorylated at the terminal 2' termini position using cleavable or non-cleavable phosphate groups. In some embodiments the present invention provides an otic pharmaceutical composition comprising a therapeutically effective amount of an double stranded RNA compound, wherein said double stranded RNA compound is blunt ended and is non-phosphorylated at the termini; however, comparative experiments have shown that double stranded RNA compounds phosphorylated at one or both of the 3'-termini have similar activity in vivo compared to the non-phosphorylated compounds.

The otic pharmaceutical compositions of the invention can be prepare using any double stranded RNA sequence disclosed herein and having any of the modifications/structures disclosed herein and any of such compositions can be used in the treatment of the conditions disclosed herein.

Unless otherwise indicated, in preferred embodiments of the structures discussed herein the covalent bond between each consecutive N and N' is a phosphodiester bond.

In various embodiments an otic pharmaceutical composition of the invention comprises (a) a therapeutically effective amount of at least one oligonucleotide compound which inhibits the expression of a human target gene associated with a disease, a disorder or an injury of the CNS; (b) a permeability enhancer and (c) a pharmaceutically acceptable excipient or carrier, or mixtures thereof. In some embodiments the oligonucleotide sequence of antisense strand is fully complementary to the oligonucleotide sequence of sense. In other embodiments the antisense and sense strands are substantially complementary. In certain embodiments the antisense strand is fully complementary to about 18 to about 40 consecutive ribonucleotides a target mRNA set forth in any one of SEQ ID NOS:1-293. In other embodiments the antisense strand is substantially complementary to about 18 to about 40 consecutive ribonucleotides a target mRNA set forth in any one of SEQ ID NOS:1-293. In some embodiments the sequence of the antisense strand is substantially complementary to from about 18 to about 40 consecutive ribonucleotides in an mRNA of a target gene associated with a disease, a disorder or an injury of the CNS.

In some embodiments the present invention provides an otic pharmaceutical composition comprising an expression vector comprising an antisense oligonucleotide substantially complementary to from about 18 to about 40 consecutive ribonucleotides in an mRNA of a target gene associated with a disease, a disorder or an injury of the CNS. In some embodiments the expression vector further comprises a sense oligonucleotide having complementarity to the antisense oligonucleotide. In various embodiments the present invention further provides a cell comprising an expression vector comprising an antisense oligonucleotide substantially complementary to from about 18 to about 40 consecutive ribonucleotides in an mRNA of a target gene disclosed in Table A. The present invention further provides a siRNA expressed in a cell comprising an expression vector comprising an antisense oligonucleotide disclosed in Table A, a pharmaceutical composition comprising same and use thereof for treatment of any one of the diseases and disorders disclosed herein.

In other embodiments the present invention provides an otic pharmaceutical composition comprising a first expression vector comprising an antisense oligonucleotide substantially complementary to from about 18 to about 40 consecutive ribonucleotides in an mRNA of a target gene disclosed in Table A and a second expression vector comprising a sense oligonucleotide having complementarity to the antisense oligonucleotide comprised in the first expression vector. In various embodiments the present invention further provides a cell comprising a first expression vector comprising an antisense oligonucleotide substantially complementary to from about 18 to about 40 consecutive ribonucleotides in an mRNA of a target gene disclosed in Table A and a second expression vector comprising a sense oligonucleotide having complementarity to the antisense oligonucleotide comprised in the first expression vector. The present invention further provides a siRNA expressed in a cell comprising such first and second expression vector, a pharmaceutical composition comprising same and use thereof for treatment of any one of the diseases and disorders disclosed herein.

Synthesis of Double Stranded RNA Compounds

Using proprietary algorithms, algorithms known in the art and the known sequence of a target gene associated with a disease, a disorder or an injury of the CNS, the sequences of many potential double stranded RNA compounds are generated. Double stranded RNA molecules according to the above specifications are prepared essentially as described herein.

The double stranded RNA compounds useful in preparation of the otic pharmaceutical compositions of present invention are synthesized by any of the methods that are well known in the art for synthesis of ribonucleic (or deoxyribonucleic) oligonucleotides. Such synthesis is, among others, described in Beaucage and Iyer, Tetrahedron 1992; 48:2223-2311; Beaucage and Iyer, Tetrahedron 1993; 49: 6123-6194 and Caruthers, et. al., Methods Enzymol. 1987; 154: 287-313; the synthesis of thioates is, among others, described in Eckstein, Ann. Rev. Biochem. 1985; 54: 367-402, the synthesis of RNA molecules is described in Sproat, in Humana Press 2005 edited by Herdewijn P.; Kap. 2: 17-31 and respective downstream processes are, among others, described in Pingoud et al., in IRL Press 1989 edited by Oliver R. W. A.; Kap. 7: 183-208.

Other synthetic procedures are known in the art, e.g. the procedures described in Usman et al., 1987, J. Am. Chem. Soc., 109, 7845; Scaringe et al., 1990, NAR., 18, 5433; Wincott et al., 1995, NAR. 23, 2677-2684; and Wincott et al., 1997, Methods Mol. Bio., 74, 59, may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as desired.

The oligonucleotides useful in preparation of the otic pharmaceutical compositions of the present invention can be synthesized separately and joined together post-synthetically, for example, by ligation (Moore et al., 1992, Science 256, 9923; Draper et al., International Patent Publication No. WO 93/23569; Shabarova et al., 1991, NAR 19, 4247; Bellon et al., 1997, Nucleosides & Nucleotides, 16, 951; Bellon et al., 1997, Bioconjugate Chem. 8, 204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the siRNAs or siRNA fragments of the present invention, two or more such sequences can be synthesized and linked together for use in the present invention.

The double stranded RNA compounds useful in preparation of the otic pharmaceutical compositions of the invention can also be synthesized via tandem synthesis methodology, as described for example in US Patent Publication No. US 2004/0019001, wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker is selected from a polynucleotide linker or a non-nucleotide linker.

Pharmaceutical Compositions

While it is possible for the oligonucleotide compounds of the present invention to be administered into the ear as the raw chemical, it is preferable to present them as an otic pharmaceutical composition. In some embodiments the one or more oligoribonucleotide compounds are produced by endogenous intracellular complexes.

The instant invention relates to a method of treatment of a disease, a disorder or an injury of the CNS in a subject comprising administering to the ear canal of the subject a therapeutically effective amount of an otic pharmaceutical composition comprising one or more therapeutic double stranded RNA compounds. Thus, the method of the invention recognizes that otic administration of a therapeutically effective amount of one or more double stranded RNA compounds according to the invention is useful to treat or prevent a disease, a disorder or an injury of the CNS in a subject in need thereof.

The inventors of the present invention have overcome many of the obstacles in development of a composition for delivery of a therapeutic oligonucleotide to the CNS. Accordingly, the present invention provides an otic pharmaceutical composition comprising one or more inhibitory oligonucleotide compounds in an amount effective to down-regulate expression of a mammalian or non-mammalian gene in the CNS of a subject suffering from a disease, a disorder or an injury of the CNS and a pharmaceutically acceptable carrier. In some embodiments the mammalian gene is a human gene. In some embodiments the non-mammalian gene is involved in a mammalian disease, preferably human disease. In preferred embodiments of the invention the subject is a human.

The invention further provides an otic pharmaceutical composition comprising at least one double stranded RNA compound which reduces or inhibits expression of a gene selected from genes disclosed in Table A; and a pharmaceutically acceptable carrier. In some embodiments the double stranded RNA compounds are processed intracellularly by endogenous cellular complexes to produce one or more oligoribonucleotides compounds.

The invention further provides an otic pharmaceutical composition comprising one or more of chemically modified double stranded RNA compounds in an amount effective to inhibit expression in a CNS cell of a target gene that is associated with a disease, a disorder or an injury of the CNS, the double stranded RNA compound comprising a sequence which is substantially complementary to the sequence of the mRNA of the target gene, and a pharmaceutically acceptable carrier.

The invention further provides an otic pharmaceutical composition comprising one or more inhibitory oligonucleotide compounds; a permeability enhancer and a pharmaceutically acceptable vehicle or carrier. In some embodiments the composition comprises a mixture of two or more different oligonucleotides/siRNA compounds.

In various embodiments the penetration enhancer is selected from any compound or any combination of two ore more compounds that enhance the penetration of a therapeutic oligonucleotide through the skin and/or the tympanic membrane in the ear of a subject suffering from or at risk of a disease, a disorder or an injury of the CNS. In some embodiments the penetration/permeability enhancer is selected from, without being limited to, polyethylene glycol (PEG), glycerol (glycerin), maltitol, sorbitol etc.; diethylene glycol monoethyl ether, azone, benzalkonium chloride (ADBAC), cetylperidium chloride, cetylmethylammonium bromide, dextran sulfate, lauric acid, menthol, methoxysalicylate, oleic acid, phosphatidylcholine, polyoxyethylene, polysorbate 80, sodium glycholate, sodium lauryl sulfate, sodium salicylate, sodium taurocholate, sodium taurodeoxycholate, sulfoxides, sodium deoxycholate, sodium glycodeoxycholate, sodium taurocholate and surfactants such as sodium lauryl sulfate, laureth-9, cetylpyridinium chloride and polyoxyethylene monoalkyl ethers, benzoic acids, such as sodium salicylate and methoxy salicylate, fatty acids, such as lauric acid, oleic acid, undecanoic acid and methyl oleate, fatty alcohols, such as octanol and nonanol, laurocapram, cyclodextrins, thymol, limonene, urea, chitosan and other natural and synthetic polymers.

In certain embodiments the permeability enhancer is a polyol. In some embodiments the oligonucleotide is in admixture with a polyol. Suitable polyols for inclusion in the solutions of the invention include glycerol and sugar alcohols such as sorbitol, mannitol or xylitol, polyethylene glycol and derivatives thereof.

In some embodiments the otic pharmaceutical compositions of the present invention also include one or more of various other pharmaceutically acceptable ingredients, such as, without being limited to, one or more of buffering agent, preservative, surfactant, carrier, solvent, diluent, co-solvent, viscosity building/enhancing agent, excipient, adjuvant and vehicle. In certain embodiments accepted preservatives such as benzalkonium chloride and disodium edetate (EDTA) are included in the compositions of the invention in concentrations sufficient for effective antimicrobial action, about 0.0001 to 0.1%, based on the weight of the composition.

According to one embodiment the polyol is glycerol. In various embodiments glycerol is present at a final concentration of about 0.1% to about 35%; about 1% to about 30%; about 5% to about 25%, preferably about 10% to about 20% by volume of the otic pharmaceutical composition. In some embodiments the final concentration of glycerol in the pharmaceutical composition is about 2%, 2.5%, 5%, 10%, 12.5%, 15%, 17.5%, 20%, 22.5%, 25%, 27.5% or about 30% by volume of the otic pharmaceutical composition. In one embodiment, the final concentration of glycerol in the pharmaceutical composition is about 2% by volume of the otic pharmaceutical composition. In another embodiment, the final concentration of glycerol in the pharmaceutical composition is about 10% by volume of the otic pharmaceutical composition. In yet another embodiment, the final concentration of glycerol in the pharmaceutical composition is about 20% by volume of the otic pharmaceutical composition. In some embodiments the pharmaceutical composition is brought to about the subject's body temperature, which is about 30° C. to about 38° C., prior to application to the ear.

In various embodiments the otic oligonucleotide composition are formulated for topical administration to the external ear, including the ear canal of a subject by any suitable mode of administration. Suitable modes of administration of the otic pharmaceutical compositions of the invention include invasive and non-invasive modes of administration, such as without being limited to, instillation (of ear drop solution), injection (of injectable formulation), deposition (of solid or semi-solid formulation, e.g. ointment, gel), infusion or spraying into the ear. In some embodiments the compositions of the invention are sprayed into the ear canal, producing a semi-solid (i.e. a foam or mousse) in the ear canal of the subject. The otic pharmaceutical compositions of the invention can also be impregnated in a porous media (for example, an ear wick such as a sponge, gauze, cotton, or hydrocellulose), which is suitable for insertion into the external ear canal to the tympanic membrane. In certain embodiments, the compositions of the present invention are administered topically into the ear canal as ear drops or injected through a cannula into the ear canal or sprayed into the ear canal or injected through the tympanic membrane (transtympanic injection). In some embodiments, the pharmaceutical composition is applied to the ear canal when the subject's head is tilted to one side and the treated ear is facing upward. In some embodiments the subject remains with his head tilted to one side with the treated ear facing upwards for a sufficient time to allow penetration of the otic pharmaceutical composition. In some embodiments, the pharmaceutical composition is applied to the ear using a receptacle for eardrops, for example using a dropper of for example, 10-100 microliter per drop, or a wick. In various embodiments the compositions of the present invention are brought to about the subject's body temperature, which is about 30° C. to about 38° C., prior to application to the ear. Delivery can be effected by any mean (e.g. drops, spray), using any effective instrument for placing the composition inside the ear canal or on/adjacent to the tympanic membrane) or for injecting the composition (e.g. through the tympanic membrane).

In various embodiment the at least one double stranded RNA compound is delivered to the ear of a subject in an otic pharmaceutical composition designed for topical non-invasive administration (e.g. instillation, deposition, spraying, insertion, transdermal patch). The otic pharmaceutical composition described herein is any conventional form, such as, without being limited to, a cream, a foam, a paste, an ointment, an emulsion, a solution, a gel, an hydrogel, a spray, a suspension, a microemulsion, microspheres, microcapsules, nanospheres, nanoparticles, lipid vesicles, liposomes, polymeric vesicles, patches, biological inserts, transdermal patch.

In one embodiment, the present invention provides a non-invasive method of attenuating expression of a target mRNA in a subject suffering from a disease, a disorder or an injury of the CNS, which comprises topically administering into the ear canal of the subject a pharmaceutical composition formulated as an ear drop comprising at least one oligonucleotide compound directed to the target mRNA, in an amount and over a period of time effective to attenuate expression of the target mRNA in the CNS of the subject. In a further aspect, the present invention provides a method of treating a disease, a disorder or an injury of the CNS in a subject in need thereof, which comprises topically administering to the ear canal of the subject a pharmaceutical composition formulated as an ear drop, comprising at least one oligonucleotide directed to a target gene associated with the disease, the disorder or the injury of the CNS, in an amount and over a period of time effective to treat the subject. In various embodiments the target mRNA is a mammalian or a non-mammalian mRNA. In some embodiments the mammalian mRNA is a human mRNA. In some embodiments the non-mammalian mRNA is a product of a gene involved in a mammalian disease, preferably human disease.

In some embodiments the otic pharmaceutical composition according to the present invention comprises a single type of double stranded RNA compound directed to a target gene associated with the disease, the disorder or the injury of the CNS. In some embodiments the otic pharmaceutical composition according to the present invention comprises two or more different types of double stranded RNA compounds directed to a target gene associated with the disease, the disorder or the injury of the CNS. In some embodiments, simultaneous inhibition of the target gene by two or more different types of double stranded RNA compounds additive or synergistic effect for treatment of the diseases disclosed herein. In other embodiments otic pharmaceutical composition of the invention comprises two or more different types of double stranded RNA compounds directed to two or more target genes associated with the disease, the disorder or the injury of the CNS. In some embodiments, simultaneous inhibition of more than one target gene by the otic pharmaceutical composition of the invention provides additive or synergistic effect for treatment of the diseases disclosed herein.

In additional embodiments, the present invention provides an otic pharmaceutical composition comprising a therapeutically effective amount of an oligonucleotide compound, wherein the oligonucleotide compound is linked or bound (covalently or non-covalently) to an antibody or aptamer against cell surface internalizable molecules expressed on the target cells, in order to achieve enhanced targeting for treatment of the diseases disclosed herein. In various embodiments, an aptamer which acts like a ligand/antibody is combined (covalently or non-covalently) with a double stranded RNA compound in preparation of otic pharmaceutical compositions according to the present invention.

The present invention also provides for a process for preparing an otic pharmaceutical composition of the invention, in accordance with formulation techniques known to those skilled in the art. In some embodiments the process for preparing an otic pharmaceutical composition of the invention comprises combining, in any suitable order, a therapeutically effective amount of at least one oligonucleotide compound, one or more permeability enhancer and at least one pharmaceutically acceptable excipient or carrier, or mixtures thereof, such a composition preferably having extended chemical and/or physical stability as described herein. In some embodiments the process for preparing an otic pharmaceutical composition of the invention, comprises combining, in any suitable order, a therapeutically effective amount of at least one oligonucleotide compound, one or more permeability enhancer, at least one pharmaceutically acceptable excipient or carrier, or mixtures thereof and an antibacterial agent and/or preservative. In some embodiments, the otic pharmaceutical composition includes a pharmacologically acceptable surfactant to assist in dissolving the double stranded RNA compound. In certain embodiments an otic pharmaceutical composition of the invention further comprises an additional therapeutically active agent, such compositions being useful in combination therapies as described herein. In some embodiments of the invention the additional pharmaceutically active agent, is selected from, without being limited to, such as non-steroidal anti-inflammatory drugs, corticosteroids, antifungal, antibiotics, and the like.

In various embodiments the otic pharmaceutical compositions of the invention comprise a therapeutically effective amount of at least one double stranded RNA compound which inhibits the expression of a target gene associated with a disease, a disorder or an injury of the CNS, or salt thereof, in an amount ranging from about 0.1 mg/ml to about 100 mg/ml of the composition. In some embodiments the amount of at least one double stranded RNA compound ranges from between about 1 mg/ml to about 50 mg/ml of the otic pharmaceutical composition. In other embodiments, the amount of at least one double stranded RNA compound ranges from between about 5 mg/ml to about 20 mg/ml of the otic pharmaceutical composition.

In various embodiments a pharmaceutically acceptable excipient or carrier is selected from a physiologically acceptable aqueous carrier, such as water, sodium chloride, buffer, saline (e.g. phosphate buffered saline (PBS)), mannitol, and the like, physiologically acceptable non-aqueous carrier, such as oil, and combinations thereof. Suitable aqueous and/or non-aqueous pharmaceutically acceptable carrier or vehicle is one that has no unacceptably injurious or toxic effect on the subject when administered as a component of a composition in an amount required herein. No excipient ingredient of such a carrier or vehicle reacts in a deleterious manner with another excipient or with the therapeutic oligonucleotide compound in a composition. In certain preferred embodiments the pharmaceutically acceptable carrier is water (e.g. pyrogen free water).

In another aspect, the present invention provides an otic pharmaceutical composition according to the present invention for treating a disease, a disorder or an injury of the CNS.

Delivery

The present application provides for delivery of therapeutic oligonucleotide compounds to the CNS of a subject suffering from a disease, a disorder or injury of the CNS, by direct application of an otic pharmaceutical composition to the outer ear of the subject. In some embodiments the pharmaceutical composition is applied to the ear canal. Delivery to the ear is also refereed to as aural or otic delivery.

In some embodiments the otic pharmaceutical compositions according to the invention comprise double stranded RNA compound in liposome or lipofectin formulations and the like. Such formulations can be prepared by methods well known to those skilled in the art. Such methods are described, for example, in U.S. Pat. Nos. 5,593,972, 5,589,466, and 5,580,859, which are herein incorporated by reference.

In some embodiments formulating the compositions in liposomes benefits absorption. Additionally, in some embodiments the otic pharmaceutical compositions comprise double stranded RNA compound formulated with polyethylenimine (PEI), with PEI derivatives, e.g. oleic and stearic acid modified derivatives of branched PEI, with chitosan or with poly (lactic-co-glycolic acid) (PLGA). Formulating the compositions in e.g. liposomes, micro- or nanospheres and nanoparticles, may enhance stability and benefit absorption. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many such implants, delivery systems, and modules are well known to those skilled in the art. In various embodiments of this invention topical non-invasive formulations are selected.

The compounds are administered as, e.g. eardrops, ear cream, ear ointment, foam, mousse, spray, solution or any of the above in combination with a delivery device. Implants of the compounds are also useful. In some embodiments liquid forms are designed for administration as eardrops, also referred to as otic drops or aural drops. In some embodiments liquid compositions include aqueous solutions, with and without organic co-solvents, aqueous or oil suspensions, emulsions with edible oils, as well as similar pharmaceutical vehicles. In some embodiment, the otic pharmaceutical compositions are in a from that remains in the ear canal of a subject for at least about 30 min without leakage of the composition out of the canal. In some embodiments the otic pharmaceutical composition of the invention is designed for administration as eardrops and the subject receiving the ear drops keep his head on the side with the treated ear facing upward to prevent leakage of the drop out of the canal.

Additional formulations for improved delivery of the compounds of the present invention can include conjugation of double stranded RNA molecules to a targeting molecule. The conjugate is usually formed through a covalent attachment of the targeting molecule to the sense strand of the double stranded RNA, so as not to disrupt silencing activity. Potential targeting molecules useful in the present invention include proteins, peptides and aptamers, as well as natural compounds, such as e.g. cholesterol. For targeting antibodies, conjugation to a protamine fusion protein has been used (see for example: Song et al., Antibody mediated in vivo delivery of small interfering RNAs via cell-surface receptors, Nat. Biotechnol. 2005. 23(6):709-17).

Administration

The otic pharmaceutical compositions of the present invention are administered and dosed in accordance with good medical practice, taking into account the clinical condition of the individual patient, the disease to be treated, the site and method of administration, scheduling of administration, patient age, sex, body weight and other factors known to medical practitioners.

A "therapeutically effective dose" or a "therapeutic effective amount" refers to an amount of a pharmaceutical compound or composition which is effective to achieve an improvement in a subject or his physiological systems including, but not limited to, improved survival rate, more rapid recovery, suppressed progress of the disease, or improvement or elimination of symptoms, and other indicators as are selected as appropriate determining measures by those skilled in the art.

A "therapeutically effective dose" or a "therapeutic effective amount" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art. The otic pharmaceutical compositions of the invention are administered in a single dose or in multiple doses.

Dosage to the ear is determined, inter alia, by the activity of the oligonucleotide, the indication and the severity of the disorder and comprises administering a dose of about 0.1 ng to about 10 mg, about 1 ng to about 1 mg, or about 10 ng to about 1 mg, total oligonucleotide in pharmaceutically acceptable excipient or carrier. The concentration of double stranded RNA compound in the composition is between 0.1 mg/ml to 100 mg/ml, preferably between 1 mg/ml to 100 mg/ml, and more preferably between 5 mg/ml to 20 mg/ml.

In some embodiments the active dose of oligonucleotide compound for humans is in the range of from 1 ng/kg to about 20-100 mg/kg body weight per day, preferably about 0.01 mg to about 2-10 mg/kg body weight per day, in a regimen of a single dose or multiple doses administered in one dose per day or twice or three or more times per day for a period of 1-4 weeks or longer, or even for the life of the subject.

The otic pharmaceutical compositions of the present invention are administered to the external ear, including the ear canal of a subject by any suitable mode of administration. Suitable modes of administration of the otic oligonucleotide compositions of the invention include invasive and non-invasive mode of administration, such as without being limited to, instillation (of ear drops), injection, deposition, or spraying into the ear. In certain embodiments, the compositions of the present invention are administered topically into the ear canal as ear drops or injected through a cannula into the ear canal or injected through the tympanic membrane (transtympanic injection). In some embodiments the compositions of the present invention are warmed to a temperature of about 30° C. to about 38° C. prior to administration into the ear of the subject. In many cases, the mode of administration may depend on many factors, including without being limited to, the affected CNS regions, nature and severity of the CNS disease or condition or injury being treated, as well as other clinical conditions of the individual subject. Otic (inner ear or cochlear) implants comprising the double stranded RNA compounds are also useful.

In various embodiments the otic pharmaceutical compositions of the invention are delivered to the CNS in an amount effective to provide a protective or therapeutic effect. Examples of protective or therapeutic effects include inhibition of target protein expression or knockdown of at least one target gene. In certain embodiments inhibiting expression of at least one target gene confers upon the cells and/or tissues of the CNS neuroprotective properties.

Accordingly, the otic pharmaceutical compositions of the invention are administered in any form that allows the active ingredient(s) (i.e. at least one oligonucleotide compound) to prevent, suppress, ameliorate, or otherwise treat the CNS diseases and conditions disclosed herein. By way of non-limiting example, the otic pharmaceutical compositions can be formulated as a cream, foam, paste, ointment, emulsion, liquid solution, gel, spray, suspension, microemulsion, microspheres, microcapsules, nano spheres, nanoparticles, lipid vesicles, liposomes, polymeric vesicles, patches, biological inserts, aerosol, polymeric or polymeric-like material and/or any other form known in the art, including any form suitable for known or novel pharmaceutical delivery systems or devices, such as a removable and/or absorbable, dissolvable, and/or degradable implant. Sterile liquid pharmaceutical compositions, solutions or suspensions can be utilized invasively, for example, by transtympanic injection; or topically, e.g. by ear drop, foam, spray, gel, cream, ointment, application into the ear canal. The liquid compositions include aqueous solutions, with and without organic co-solvents, aqueous or oil suspensions, emulsions e.g. with edible oils, as well as similar pharmaceutical vehicles.

In various embodiments the otic compositions of the invention circumvent the blood-brain barrier (BBB) and are delivered directly to the CNS. In some embodiments the otic pharmaceutical composition of the invention is useful for delivery of the double stranded RNA compound directly into the CNS by transport along a neural pathway to the CNS, or by way of a perivascular channel, a prelymphatic channel, or a lymphatic channel associated with the brain, retina, optic nerve and/or spinal cord. In some embodiments the otic pharmaceutical composition of the invention delivers the double stranded RNA compound to the cerebrospinal fluid and then subsequently to the CNS, including the brain, retina, optic nerve and/or spinal cord.

In accordance with the method of the invention, the otic pharmaceutical compositions of the present invention comprising one or more chemically modified double stranded RNA compounds are delivered to the CNS by direct application of the pharmaceutical composition to the outer ear. Delivery to the ear may also be refereed to as aural or otic delivery. In various embodiments the otic pharmaceutical composition is applied to the ear canal. In some embodiments the otic pharmaceutical compositions of the invention are formulated as sterile liquid pharmaceutical compositions, solutions or suspensions and are utilized invasively, for example, by transtympanic injection. In other embodiments the otic pharmaceutical compositions of the invention are formulated for topical non-invasive administration, as cream, foam, paste, ointment, emulsion, solution, gel, spray, suspension, microemulsion, micro spheres, microcapsules, nano spheres, nanoparticles, lipid vesicles, liposomes, polymeric vesicles, patches, biological inserts, for instillation, deposition or spraying into the ear canal. In some embodiments, the otic pharmaceutical compositions of the invention are formulated for administration as ear drops (also referred to as otic drops or aural drops). In a preferred embodiment the eardrops remain in the ear canal of the subject for about 30 minutes. It is thus preferable that the subject receiving the drops keeps his head on the side to prevent leakage of the drop out of the canal.

Methods of Treatment

In one aspect the present invention provides a method of treating a subject afflicted with a disease, a disorder or an injury of the CNS, which comprises administering to the ear of the subject an otic composition comprising at least one therapeutic agent in an amount and over a period of time effective to treat the subject. In some embodiments the therapeutic agent is an oligonucleotide compound, including chemically synthesized siRNA.

Without wishing to be bound to theory, delivery of therapeutic agents to the CNS via the ear progresses along neurons by retrograde and anterograde axonal transport. Administration of therapeutic agents via the ear is a viable alternative to invasive therapies including intravitreal, intrathecal and transtympanic administration modes.

In one aspect the present invention provides a method of treating a disease, a disorder or an injury of the CNS in a subject in need thereof, which comprises administering to the ear of the subject an otic pharmaceutical composition comprising at least one oligonucleotide compound directed to a target gene associated with the disease, the disorder or the injury of the CNS, in an amount and over a period of time effective to treat the subject.

In another aspect, the present invention provides a method of attenuating expression of a target mRNA in a subject suffering from a disease, a disorder or an injury of the CNS, which comprises administering to the ear of the subject an otic pharmaceutical composition comprising at least one oligonucleotide directed to the target mRNA, in an amount and over a period of time effective to attenuate expression of the target mRNA in the CNS of the subject.

In yet another aspect the present invention provides a non-invasive method of delivery of a therapeutic oligonucleotide to a CNS in a subject suffering from a disease, a disorder or an injury of the CNS comprising topically and non-invasively administering an otic oligonucleotide composition to the ear of the subject. In yet another aspect the present invention provides a method of effecting neuroprotection to cells of the CNS in a subject in need thereof comprising administering to the subject's ear canal a therapeutic agent and an otic carrier in an amount and over a period of time effective to effect neuroprotection in the subject. In some embodiments the cells are retinal cells, in particular retinal ganglion cells. In some embodiments the cells are optic nerve cells. In other embodiments the cells are spinal cord cells or brain cells.

In some embodiments the disease disorder or injury of the CNS is associated with APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2 (p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7 and EFNB2 gene expression or activity. Thus, in another aspect the present invention relates to a method for the treatment of a subject in need of treatment for a disease or disorder or injury or symptom or condition associated with the disease or disorder, associated with the expression of a gene selected from the group consisting of APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2(p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7 and EFNB2, comprising administering to the ear of the subject an otic pharmaceutical composition comprising at least one double stranded RNA which reduces or inhibits expression of the gene in the CNS of the subject in an amount and over a period of time effective to treat the subject. In preferred embodiments the therapeutic oligonucleotide is a siRNA compound, preferably chemically modified according to the embodiments of the present invention. In preferred embodiments the subject being treated is a warm-blooded animal and, in particular a mammal, and preferably a human.

"Treating a subject" refers to administering to the subject a therapeutic substance effective to alleviate symptoms associated with a disease or condition, to delay the onset of the disease, to slow the progress of the disease, to lessen the severity or cure the disease, or to prevent the disease from occurring. "Treatment" refers to both therapeutic treatment and prophylactic or preventative measures, wherein the object is to prevent a disorder, to slow the progress of a disease or to reduce the symptoms of a disorder. Those in need of treatment include those already experiencing the disease or condition, those at risk of or prone to having the disease or condition, and those in which the disease or condition is to be prevented. The compositions of the invention are administered before, during or subsequent to the onset of the disease or condition.

Additionally, the invention provides a method of down-regulating the expression of a target gene by at least 30% as compared to a control, comprising contacting a target gene mRNA with one or more of the chemically modified double stranded RNA compound of the otic pharmaceutical compositions of the present invention.

In some embodiments topical administration of an otic pharmaceutical composition of the invention, which comprises at least one oligonucleotide directed to a target gene associated with the disease, the disorder or the injury of the CNS, inhibits or down-regulates the mammalian APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2(p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7 and EFNB2 gene whereby the inhibition or down-regulation is selected from the group comprising inhibition of down-regulation of gene function, inhibition and down-regulation of mRNA expression and inhibition or down-regulation of corresponding polypeptide.

The present invention provides a method of inhibiting the expression of a target gene in a subject suffering from a disease, a disorder or an injury of the CNS, which comprises administering to the ear of the subject an otic pharmaceutical composition comprising at least one oligonucleotide directed to the target gene, in an amount and over a period of time effective to inhibit expression of the target gene in the CNS of the subject.

In another aspect, the invention provides a method of inhibiting the expression of a target gene in a subject suffering from a disease, a disorder or an injury of the CNS, by at least 30%, preferably by 40%, 50%, 60% or 70%, more preferably by 75%, 80% or 90% as compared to a control, which comprises administering to the ear of the subject an otic pharmaceutical composition comprising at least one oligonucleotide directed to the target gene, in an amount and over a period of time effective to inhibit expression of the target gene in the CNS of the subject.

In another aspect, the invention provides a method of inhibiting the expression of the target gene by at least 30%, preferably by 40%, 50%, 60% or 70%, more preferably by 75%, 80% or 90% as compared to a control comprising contacting an mRNA transcript of the target gene with one or more of the double stranded RNA compounds of the otic pharmaceutical compositions of the invention.

In various embodiments the effect of inhibition of a target gene by the otic pharmaceutical compositions comprising an oligonucleotide inhibitor (e.g. chemically modified siRNA compound) is determined by examining siRNA effect on the mRNA or on the corresponding protein product of the target gene, whereby the inhibition is selected from the group comprising inhibition of function (which is examined by, for example, an enzymatic assay or a binding assay with a known interactor of the native gene/polypeptide, inter alia), inhibition of protein (which is examined by, for example, Western blotting, ELISA or immuno-precipitation, inter alia) and inhibition of target gene mRNA expression (which is examined by, for example, Northern blotting, quantitative RT-PCR, in-situ hybridization or microarray hybridization, inter alia).

In some embodiments an otic pharmaceutical composition of the invention comprising at least one chemically modified double stranded RNA compound is down-regulating the target gene or polypeptide, whereby the down-regulation is selected from the group comprising down-regulation of function (which is examined by, for example, an enzymatic assay or a binding assay with a known interactor of the native gene/polypeptide, inter alia), down-regulation of protein (which is examined by, for example, Western blotting, ELISA or immuno-precipitation, inter alia) and down-regulation of target gene mRNA expression (which is examined by, for example, Northern blotting, quantitative RT-PCR, in-situ hybridization or microarray hybridization, inter alia).

In additional embodiments the invention provides a method of treating a subject suffering from or susceptible to any disease or disorder or injury of the CNS accompanied by an elevated level of a mammalian target gene associated with a disease, a disorder or an injury of the CNS, which comprises topically administering to the canal of the subject's ear an otic pharmaceutical composition comprising: (a) a therapeutically effective amount of at least one oligonucleotide compound which inhibits the expression of a mammalian target gene associated with a disease, a disorder or an injury of the CNS; (b) a permeability enhancer or mixtures thereof and (c) a pharmaceutically acceptable excipient or carrier, or mixtures thereof, thereby treating the subject. In various embodiments of the invention the mammalian target gene is a human target gene. In some embodiments the target gene is selected from one or more of SEQ ID NO:1-293.

Methods and novel otic pharmaceutical compositions comprising chemically modified double stranded RNA compounds which inhibit a mammalian target gene associated with a disease, a disorder or an injury of the CNS, or polypeptide expression thereof, are discussed herein at length, and any of said double stranded RNA molecules and/or pharmaceutical compositions are beneficially employed in the treatment of a subject suffering from or susceptible to any of said conditions.

The method of the invention further includes non-invasive administration of an otic pharmaceutical composition comprising a therapeutically effective amount of one or more of chemically modified double stranded RNA compounds which down-regulate expression of a target gene associated with a disease, a disorder or an injury of the CNS. In some specific embodiments the target gene is selected from the group consisting of the genes set forth in Table A.

Combination Therapy

The methods of treating the diseases disclosed herein include administering a novel otic pharmaceutical composition comprising at least one chemically modified double stranded RNA compound directed to a target gene associated with a disease, a disorder or an injury of the CNS in conjunction or in combination with an additional inhibitor directed to a target gene associated with a disease, a disorder or an injury of the CNS, and/or a substance which improves the pharmacological properties of the chemically modified double stranded RNA compound, and/or an additional compound known to be effective in the treatment of a subject suffering from or susceptible to neurodegenerative disease, a neurological disorder, a malignancy or a tumor, an affective disorder, or nerve damage resulting from a cerebrovascular disorder, injury, or infection of the CNS.

Combination therapies comprising known treatments for treating a subject suffering from or affected by or susceptible to diseases, disorders or injury of the CNS, in conjunction with the novel otic pharmaceutical compositions and therapies described herein are considered part of the current invention.

In certain embodiments, the otic pharmaceutical compositions of the invention further comprise a known therapeutically active compound which is directed to treatment of CNS conditions (e.g. Cholinesterase inhibitors, glutamate regulators, etc.). Appropriate therapeutic amount of such a known second therapeutic agents for use in combination with an otic pharmaceutical composition of the invention are readily appreciated by those skilled in the art.

In some embodiments the combinations referred to above are presented for use in the form of a single pharmaceutical formulation.

The administration of an otic pharmaceutical composition of the invention to the subject's ear is carried out by any of the many known routes of administration, including invasive and non-invasive methods of administration, as determined by a skilled practitioner. Using specialized formulations, it is possible to administer the compositions, inter alia, by instillation (e.g. of ear drops), injection, deposition, or spraying into the ear.

By "in conjunction with" or "in combination with" is meant that the additional pharmaceutically effective compound is administered prior to, at the same time as, or subsequent to administration of the otic pharmaceutical compositions of present invention. The individual components of such a combination referred to above, therefore, are administered either sequentially or simultaneously from the same or separate pharmaceutical formulations. As is the case for the present otic pharmaceutical compositions, a second therapeutic agent is administered by any suitable route, for example, by otic, oral, buccal, inhalation, sublingual, rectal, vaginal, transurethral, nasal, topical, percutaneous (i.e., transdermal), or parenteral (including intravenous, intramuscular, subcutaneous, and intracoronary) administration.

In some embodiments, an oligonucleotide of the invention and the second therapeutic agent/composition are administered by the same route, either provided in a single composition or as two or more different pharmaceutical compositions. However, in other embodiments, a different route of administration for the novel otic pharmaceutical compositions of the invention and the second therapeutic composition/agent is either possible or preferred. Persons skilled in the art are aware of the best modes of administration for each therapeutic agent, either alone or in combination.

In another aspects, the present invention provides an otic pharmaceutical composition comprising two or more double stranded RNA molecules for the treatment of any of the diseases and conditions mentioned herein. In some embodiments the two or more double stranded RNA molecules or formulations comprising said molecules are admixed in the pharmaceutical composition in amounts which generate equal or otherwise beneficial activity. In certain embodiments the two or more double stranded RNA molecules are covalently or non-covalently bound, or joined together by a nucleic acid linker of a length ranging from 2-100, preferably 2-50 or 2-30 nucleotides.

In certain one embodiment, the two or more double stranded RNA molecules target mRNA to APP, MAPT, SOD1, BACE1, CASP3, TGM2, TARDBP, ADRB1, CAMK2A, CBLN1, CDK5R1, GABRA1, MAPK10, NOS1, NPTX2, NRGN, NTS, PDCD2, PDE4D, PENK, SYT1, TTR, FUS, LRDD, CYBA, ATF3, CASP2, HRK, C1QBP, BNIP3, MAPK8, MAPK14, Rac1, GSK3B, P2RX7, TRPM2, PARG, CD38, STEAP4, BMP2, GJA1, TYROBP, CTGF, ANXA2, DUOX1, RTP801, RTP801L, NOX4, NOX1, NOX2 (gp91pho, CYBB), NOX5, DUOX2, NOXO1, NOXO2 (p47phox, NCF1), NOXA1, NOXA2 (p67phox, NCF2), p53 (TP53), HTRA2, KEAP1, SHC1, ZNHIT1, LGALS3, SESN2, SOX9, ASPP1, CTSD, CAPNS1, FAS, FASLG, CAPN1, FADD, CASP1, CASP9, p75NTR, PARK2, HTT (with expanded repeats), NogoA, MAG, OMGP, NgR1, PDE4, BCAN, NCAN, PTPRZ1, TNC, NRP1, NRP2, PLXNA1, PLXNA2, PLXNB1, PLXNC1, TROY, LRRC1, ROCK1, LimK1, LimK2, CFL1, KCNC4, KCNE3, NAT8L, FKBP1A, FKBP4, LRRK2, DYRK1A, AKAP13, UBE2K, WDR33, MYCBP2, SEPHS1, HMGB1, HMGB2, TRPM7, BECN1, THEM4, SLC4A7, MMP9, SLC11A2, ATXN3, ATXN1, ATXN7, PRNP, EFNB3, EPHA4, EFNA5, EPHA7 and EFNB2. In some embodiments at least one of the two or more double stranded RNA compounds target the genes set forth in Table A. In some embodiments the pharmaceutical compositions of the invention further comprise one or more additional double stranded RNA molecule, which targets one or more additional target gene. In some embodiments, simultaneous inhibition of said additional gene(s) provides an additive or synergistic effect for treatment of the diseases disclosed herein.

The treatment regimen according to the invention is carried out, in terms of administration mode, timing of the administration, and dosage, so as to thereby treat a subject suffering from or susceptible to neurodegenerative disease, a neurological disorder, a malignancy or a tumor of the CNS, an affective disorder, or nerve damage resulting from a cerebrovascular disorder, injury, or infection of the CNS.

Indications

In various embodiments the otic pharmaceutical compositions of the invention are useful in treating or preventing various diseases, disorders and injury that affect the central nervous system (CNS), such as, without being limited to, the diseases, disorders and injury that are disclosed herein below.

Ocular Diseases

Delivery of therapeutic oligonucleotide compounds via the ear is useful in the treatment of a broad spectrum of eye diseases and disorders in which neuroprotection of the optic nerve would be of benefit, for example in: open angle primary/secondary glaucoma, multiple sclerosis (optic neuritis), central or brunch retinal vein occlusion, ischemic optic neuropathy (in status epilepticus, HIV-1 infection), optic nerve injury, tumors extending into the suprasellar region (above the sella turcica), juxta chiasmal tumors (the visual loss associated with compression of the optic chiasm by pituitary tumors may be transient or permanent, possibly related to the extent of irreversible retrograde degeneration to the retinal ganglion cells, Retinoblastoma.

In some embodiments the eye disorder, disease or injury is selected from glaucoma, diabetic retinopathy (DR), diabetic macular edema (DME), age related macular degeneration (AMD) Leber's hereditary optic neuropathy (LHON) or Leber optic atrophy. In some embodiments the disorder is a primary glaucoma, selected from primary open angle glaucoma, normal-tension glaucoma or angle-closure glaucoma. In some embodiments the disorder is a progressing glaucoma. In some embodiments the disorder is a secondary glaucoma selected from pseudoexfoliation glaucoma, pigmentary glaucoma, neovascular glaucoma, steroid-induced glaucoma, acute angle closure glaucoma or treatment refractory glaucoma. In other embodiments the ocular disorder, disease or injury is optic neuritis, central retinal vein occlusion, brunch retinal vein occlusion (BRVO). In further embodiments the eye disorder, disease or injury is retinitis pigmentosa (RP), ischemic optic neuropathy or optic nerve injury. In some embodiment the optic neuropathy is selected from non-arteritic anterior ischemic optic neuropathy (NAION), optic neuritis, neuromyelitis optica, dominant optic atrophy, Leber's hereditary optic neuropathy. In further embodiments ocular disorder, disease or injury is retinopathy of prematurity (ROP) retinal ganglion degeneration, macular degeneration, hereditary optic neuropathy, metabolic optic neuropathy, optic neuropathy due to a toxic agent or neuropathy caused by adverse drug reactions or vitamin deficiency. In yet another embodiment the disorder is vision loss associated with a tumor.

Primary Open-Angle Glaucoma

The majority of the cases of glaucoma are the form known as primary-open-angle glaucoma POAG, also called chronic open-angle glaucoma). POAG results from a build up of aqueous humor fluid within the anterior chamber of the eye resulting in intraocular pressure (IOP). Elevated IOP, which can be measured by a "tonometry" test, results from fluid entering the eye and not enough fluid exiting the eye. Normally, fluid enters the eye by seeping out of the blood vessels in the ciliary body. This fluid eventually makes its way past the crystalline lens, through the pupil (the central opening in the iris), and into the irido-corneal angle, the anatomical angle formed where the iris and the cornea come together. Then the fluid passes through the trabecular meshwork in the angle and leaves the eye via the canal of Schlemm.

If excess fluid enters the eye, or if the trabecular meshwork "drain" gets clogged up (for instance, with debris or cells) so that not enough fluid is leaving the eye, the pressure builds up in what is known as "open angle glaucoma." Open angle glaucoma also can be caused when the posterior portion of the iris adheres to the anterior surface of the lens creating a "pupillary block", and preventing intraocular fluid from passing through the pupil into the anterior chamber.

If the angle between the iris and the cornea is too narrow or is even closed, then the fluid backs up, causing increased pressure in what is known as "closed angle glaucoma."

Untreated glaucoma eventually leads to optic atrophy and blindness.

Normal Tension Glaucoma

Intraocular eye pressure is normal (between 12-22 mmHg) in about 25-30% glaucoma cases in the US, a condition known as normal-tension glaucoma. (In Japan, the rates may be as high as 70%.) Other factors are present that cause optic nerve damage but do not affect IOP.

Closed-Angle Glaucoma

Closed-angle glaucoma (also called angle-closure glaucoma) is responsible for 15% of all glaucoma cases. It is less common than POAG in the U.S., but it constitutes about half of the world's glaucoma cases because of its higher prevalence among Asians. The iris is pushed against the lens, sometimes sticking to it, closing off the drainage angle. This can occur very suddenly, resulting in an immediate rise in pressure. It often occurs in genetically susceptible people when the pupil shrinks suddenly. Closed-angle glaucoma can also be chronic and gradual, a less common condition.

Congenital Glaucoma

Congenital glaucoma, in which the eye's drainage canals fail to develop correctly, is present from birth. It is very rare, occurring in about 1 in 10,000 newborns. This may be an inherited condition and often can be corrected with microsurgery.

In one aspect the present invention provides a method of attenuating expression of a target ocular mRNA in the eye of a subject suffering from glaucoma, comprising topically (non-invasively) administering to the surface of the eye of the subject an effective amount of at least one chemically modified double stranded RNA and a pharmaceutically acceptable carrier. In certain embodiments the at least one ocular target mRNA is a product of a gene selected from a list in Table A set forth in SEQ ID NOS:1-293. In certain preferred embodiments the target ocular mRNA is a product of a gene selected from CASP2, ASPP1, TP53BP2, BNIP3, RTP801L, ACHE, ADRB1 and CAPNS1. In a currently preferred embodiment the double stranded RNA is formulated for delivery as ear drops. In various embodiments the target ocular mRNA set forth in SEQ ID NOS:22-23.

Neurodegenerative Disease

Neurodegenerative diseases are conditions in which cells of the CNS (the brain and/or the spinal cord and/or the eye) are lost. The CNS cells are not readily regenerated en masse, so excessive damage can be devastating. Neurodegenerative diseases result from deterioration of neurons or their myelin sheath, which over time leads to dysfunction and disabilities. They are crudely divided into two groups according to phenotypic effects, although these are not mutually exclusive: conditions affecting movement, such as ataxia; and conditions affecting memory and related to dementia. Dementia is marked by loss of intellectual functions such as memory, learning, reasoning, problem solving, and abstract thinking while vegetative functions remain intact. Non-limiting examples of neurodegenerative disease are Alzheimer's disease, Amyotrophic lateral sclerosis (ALS, also known as Lou Gehrig's Disease), Huntington's disease, Lewy body dementia and Parkinson's disease.

Another type of neurodegenerative diseases includes diseases caused by misfolded proteins, or prions. Non-limiting examples of prion diseases in humans are Creutzfeldt-Jakob disease (CJD) and variant CJD (Mad Cow Disease).

Non-limiting examples of ocular neurodegenerative disease include photoreceptor loss in the retina in subjects afflicted with macular degeneration, diabetic retinopathy, retinitis pigmentosa, glaucoma, and similar diseases.

In various embodiments the otic pharmaceutical compositions of the invention are useful for treating neurodegenerative diseases and conditions.

The otic pharmaceutical compositions of the present invention are particularly useful in treating a subject suffering from or affected by or susceptible to neurodegenerative disorders, including, without being limited to, Parkinson's disease, Amyotrophic Lateral Sclerosis (ALS), Prion disease dementia, Alzheimer's disease, Lewy body dementia, Pick's disease, Ataxia-telangiectasia (AT), Frontotemporal dementia (FTD), Frontotemporal lobar degeneration (FTLD), Huntington's disease, HIV-associated dementia, post-stroke dementia or any other disease-induced dementia; and ocular neurodegenerative diseases.

Alzheimer's Disease (AD)

In one embodiment the neurodegenerative disorder is Alzheimer's disease (AD). AD is progressive, neurodegenerative disease characterized by loss of function and death of nerve cells in several areas of the brain leading to loss of cognitive function such as memory and language.

Thus the present invention further provides a method of treating AD in a subject in need of treatment that comprises administering to the ear of the subject an otic pharmaceutical composition which comprises a therapeutically effective amount of at least one oligonucleotide compound, which inhibits expression of at least one gene expressed in the CNS of the subject in an amount effective to treat AD. In various embodiments the oligonucleotide compound is selected from the group consisting of an antisense, an unmodified double stranded RNA, a chemically modified double stranded RNA, a shRNA, an aptamer, a ribozyme, or a DNA compound. In preferred embodiments of the invention the oligonucleotide compound is chemically modified siRNA.

In certain embodiments the chemically modified double stranded RNA inhibits expression of at least one target gene expressed in the CNS of the subject and associated with an AD. In certain embodiments inhibition of at least one target gene confers upon the CNS neuroprotective properties.

In yet another aspect, the present invention provides a method of attenuating expression of a target mRNA in a subject suffering from an AD. In certain embodiments the at least one target mRNA is selected from an mRNA polynucleotide set forth in any one of SEQ ID NOS:1-293. In certain preferred embodiments the gene is selected from APP (SEQ ID NO:1-5), BACE1 (SEQ ID NO:13-16), ADRB1 (SEQ ID NO:31), CDK5R1 (SEQ ID NO:35), MAPT (SEQ ID NO:6-11), CASP3 (SEQ ID NO:24-25), TGM2 (SEQ ID NO:28-29), CAMK2A (SEQ ID NO:32-33), GABRA1 (SEQ ID NO:36-42), SYT1 (SEQ ID NO:63-65) and CASP2 (SEQ ID NO: 22-23).

Amyotrophic Lateral Sclerosis (ALS)

In one embodiment the neurodegenerative disorder is Amyotrophic Lateral Sclerosis (ALS). ALS a progressive, usually fatal, neurodegenerative disease caused by the degeneration of motor neurons, the nerve cells in the central nervous system that control voluntary muscle movement. The disorder causes muscle weakness and atrophy throughout the body as both the upper and lower motor neurons degenerate, ceasing to send messages to muscles. Unable to function, the muscles gradually weaken, develop fasciculations (twitches) because of denervation, and eventually atrophy because of that denervation. Subject suffering from ALS may ultimately lose the ability to initiate and control all voluntary movement; bladder and bowel sphincters and the muscles responsible for eye movement are usually (but not always) spared.

Thus the present invention further provides a method of treating ALS in a subject in need of treatment that comprises administering to canal of the subject's ear an otic pharmaceutical composition which comprises a therapeutically effective amount of at least one oligonucleotide compound, which inhibits expression of at least one target gene expressed in the CNS of the subject in an amount effective to treat ALS. In various embodiments the oligonucleotide compound is selected from the group consisting of an antisense, an unmodified siRNA, a chemically modified siRNA, a shRNA, an aptamer, a ribozyme, a dsRNA or DNA compound. In preferred embodiments of the invention the oligonucleotide compound is chemically modified siRNA.

In certain embodiments the chemically modified siRNA inhibits expression of at least one target gene expressed in the CNS of the subject and associated with ALS. In certain embodiments inhibition of at least one gene confers upon the CNS neuroprotective properties.

In yet another aspect, the present invention provides a method of attenuating expression of a target mRNA in a subject suffering from an ALS. In certain embodiments the at least one target mRNA is selected from an mRNA polynucleotide set forth in any one of SEQ ID NOS:1-293. In certain preferred embodiments the gene is selected from SOD1 (SEQ ID NO:12), TARDBP (SEQ ID NO:30), CBLN1 (SEQ ID NO:34), CDK5R1 (SEQ ID NO:35), FUS (SEQ ID NO:67-70) and CASP2 (SEQ ID NO:22-23).

Parkinson's Disease (PD)

In one embodiment the neurodegenerative disorder is Parkinson's Disease (PD). Parkinson's disease is a progressive disorder of the nervous system marked by muscle tremors, muscle rigidity, decreased mobility, stooped posture, slow voluntary movements, and a mask-like facial expression.

Thus the present invention further provides a method of treating PD in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat PD. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with PD. In certain embodiments inhibition of at least one gene confers upon the CNS neuroprotective properties.

In yet another aspect, the present invention provides a method of attenuating expression of a target mRNA in a subject suffering from PD. In certain embodiments the at least one target mRNA is selected from an mRNA polynucleotide set forth in any one of SEQ ID NOS:1-293. In certain preferred embodiments the gene is selected from MAPT (SEQ ID NO:4-7), NPTX2 (SEQ ID NO:26), SYT1 (SEQ ID NO:32), MAPK10 (SEQ ID NO:24), NTS (SEQ ID NO:28), PDCD2 (SEQ ID NO:29), PENK (SEQ ID NO:31), CBLN1 (SEQ ID NO:21) and CASP2 (SEQ ID NO: 22-23).

Ataxia-Telangiectasia (AT)

In one embodiment the neurodegenerative disorder is Ataxia-telangiectasia (AT). AT is a rare, neurodegenerative, inherited disease which affects many parts of the body and causes severe disability. Ataxia refers to poor coordination and telangiectasia to small, dilated blood vessels, both of which are hallmarks of the disease. AT affects the cerebellum (the body's motor coordination control center) and also weakens the immune system in about 70% of the cases, leading to respiratory disorders and increased risk of cancer.

Thus the present invention further provides a method of treating AT in a subject in need of treatment that comprises administering to the ear of the subject an otic pharmaceutical composition which comprises a therapeutically effective amount of at least one oligonucleotide compound, which inhibits expression of at least one gene expressed in the CNS of the subject in an amount effective to treat AT. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with AT. In certain embodiments inhibition of at least one gene confers upon the CNS neuroprotective properties.

In yet another aspect, the present invention provides a method of attenuating expression of a target mRNA in a subject suffering from AT. In certain embodiments the at least one target mRNA is selected from an mRNA polynucleotide set forth in any one of SEQ ID NOS:1-293. In one preferred embodiment the gene is CBLN1 (SEQ ID NO:21).

Frontotemporal Lobar Degeneration (FTLD)

In one embodiment the neurodegenerative disorder is Frontotemporal lobar degeneration (FTLD). FTLD is the name for a group of clinically, pathologically and genetically heterogeneous disorders associated with atrophy in the frontal lobe and temporal lobe of the brain, with sparing of the parietal and occipital lobes. In the over 65 age group, FTLD is probably the fourth most common cause of dementia after Alzheimer's disease, Dementia with Lewy bodies and vascular dementia. In the below 65 age group, it is the second most common cause after Alzheimer's disease.

There are three clinical subtypes described: frontotemporal dementia, semantic dementia and progressive nonfluent aphasia. Histopathologically, FTLD is distinct from Alzheimer's disease (AD) but heterogenous, even among similar clinical syndromes. Recently, it has been recognized that FTLD is closely related to, and sometimes overlaps with three other neurodegenerative diseases: corticobasal ganglionic degeneration (CBD), progressive supranuclear palsy (PSP), and motor neuron disease (MND). The central role of the microtubule-associated protein, tau, in the pathogenesis of FTLD and these related disorders has led to their classification as "taopathies".

Thus the present invention further provides a method of treating FTLD in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat FTLD. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with FTLD. In certain embodiments inhibition of at least one gene confers upon the CNS neuroprotective properties.

In yet another aspect, the present invention provides a method of attenuating expression of a target mRNA in a subject suffering from FTLD. In certain embodiments the at least one target mRNA is selected from an mRNA polynucleotide set forth in any one of SEQ ID NOS:1-293. In certain preferred embodiments the gene is selected from MAPT (SEQ ID NO:4-7) and TARDBP (SEQ ID NO:18).

Frontotemporal Degeneration (FTD)

In one embodiment the neurodegenerative disorder is Frontotemporal degeneration (FTD). FTD is a non-Alzheimer dementia that may rank as the second most common cause of early onset dementia. Both behavioral and language presentations of FTD usually have earlier onset (mean onset in sixth decade of life) than Alzheimer disease (AD) (mean onset in eighth decade of life).

Thus the present invention further provides a method of treating FTD in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat FTD. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with FTD. In certain embodiments inhibition of at least one gene confers upon the CNS neuroprotective properties.

In yet another aspect, the present invention provides a method of attenuating expression of a target mRNA in a subject suffering from FTD. In certain embodiments the at least one target mRNA is selected from an mRNA polynucleotide set forth in any one of SEQ ID NOS:1-293. In one preferred embodiment the gene is NPTX2 (SEQ ID NO:26).

Pick's Disease (PiD)

In one embodiment the neurodegenerative disorder is Pick's disease (PiD). PiD is a rare neurodegenerative disease that is sometimes familial. Numerous different areas of the brain are affected by PiD, but the specific areas that are affected allow for differentiation between PiD and Alzheimer's disease. Pick's disease (the pathology) causes progressive destruction of nerve cells in the brain and causes tau proteins to accumulate into "Pick bodies" that are a defining characteristic of the disease. Pick's disease is one of the causes of the clinical syndrome of frontotemporal lobar degeneration which has three subtypes. Pick's disease pathology is associated more with the frontotemporal dementia and progressive nonfluent aphasia subtypes than the semantic dementia subtype. PiD has several unique biochemical characteristics that allow for unique identification of Pick's disease as opposed to other pathological subtypes of frontotemporal lobar degeneration. Clinical features include aphasia; apraxia; confusion; anomia; memory loss; and personality deterioration. This pattern is consistent with the pathologic findings of circumscribed atrophy of the poles of the frontal lobe and temporal lobe. Neuronal loss is maximal in the hippocampus, entorhinal cortex, and amygdala. Some ballooned cortical neurons contain argentophylic (Pick) bodies (for further details see Brain Pathol 1998 April; 8(2):339-54 and Adams et al., Principles of Neurology, 6th ed, pp 1057-9).

Thus the present invention further provides a method of treating PiD in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat PiD. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with PiD. In certain embodiments inhibition of at least one gene confers upon the CNS neuroprotective properties.

In yet another aspect, the present invention provides a method of attenuating expression of a target mRNA in a subject suffering from PiD. In certain embodiments the at least one target mRNA is selected from an mRNA polynucleotide set forth in any one of SEQ ID NOS:1-293. In one preferred embodiment the gene is MAPT (SEQ ID NO:6-11).

Huntington's Disease (HD)

In one embodiment the neurodegenerative disorder is Huntington's disease (HD). HD incurable, genetic neurodegenerative disorder. Characteristic symptoms, which are progressive and begin subtly, include uncoordinated, jerky body movements, decline in mental abilities and behavioral and psychiatric problems. Dementia is the norm as the disease advances.

Thus the present invention further provides a method of treating HD in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat HD. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with HD. In certain embodiments inhibition of at least one gene confers upon the CNS neuroprotective properties.

In yet another aspect, the present invention provides a method of attenuating expression of a target mRNA in a subject suffering from HD. In certain embodiments the at least one target mRNA is selected from an mRNA polynucleotide HTT (SEQ ID NO:168), TGM2 (SEQ ID NO:28-29) and ADRB1 (SEQ ID NO:31).

Post Stroke Dementia (PSD)

In one embodiment the neurodegenerative disorder is Post Stroke Dementia (PSD). About 25% of people have dementia after a stroke with many others developing dementia over the following 5 to 10 years. In addition, many individuals experience more subtle impairments of their higher brain functions (such as planning skills and speed of processing information) and are at very high risk of subsequently developing dementia. Very small strokes in the deep parts of the brain in this process (called microvascular disease) seem to be essential in the process leading to an identified pattern of brain atrophy specific to post-stroke dementia.

Thus the present invention further provides a method of treating PSD in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat PSD. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with PSD. In certain embodiments inhibition of at least one gene confers upon the CNS neuroprotective properties.

In yet another aspect, the present invention provides a method of attenuating expression of a target mRNA in a subject suffering from PSD. In certain embodiments the at least one target mRNA is selected from an mRNA polynucleotide set forth in any one of SEQ ID NOS:1-293.

Ocular Neurodegenerative Diseases

In one embodiment the neurodegenerative disease is a neurodegenerative disease of the eye, including photoreceptor loss in the retina in subjects afflicted with macular degeneration, diabetic retinopathy, retinitis pigmentosa, glaucoma, and similar diseases.

Thus the present invention further provides a method of treating an ocular neurodegenerative disease in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat an ocular neurodegenerative disease. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with the ocular neurodegenerative disease. In certain embodiments inhibition of at least one gene confers upon the CNS neuroprotective properties.

In yet another aspect, the present invention provides a method of attenuating expression of a target mRNA in a subject suffering from ocular neurodegenerative disease. In certain embodiments the at least one target mRNA is selected from an mRNA polynucleotide set forth in any one of SEQ ID NOS:1-293. In one preferred embodiment the gene is CASP2 (SEQ ID NO:22-23).

Injury of the Central Nervous System (CNS)

In various embodiments the otic pharmaceutical compositions of the invention are useful for treating injury of the central nervous system (CNS).

The otic pharmaceutical compositions of the present invention are particularly useful in treating a subject suffering from or affected by or susceptible to injury of the CNS, including, without being limited to, traumatic and non-traumatic spinal cord injury, and brain injury (e.g. Traumatic Brain Injury (TBI)), that is caused by fracture or penetration of the skull (i.e. a vehicle accident, fall, gunshot wound), a disease process (i.e. neurotoxins, infections, tumors, metabolic abnormalities, etc.) or a closed head injury such as in the case of rapid acceleration or deceleration of the head (i.e. Shaken Baby Syndrome, blast), blunt trauma, concussions, and concussion syndrome.

Additionally, an ischemic episode may be caused by a mechanical injury to the Central Nervous System, such as results from a blow to the head or spine. Trauma can involve a tissue insult such as an abrasion, incision, contusion, puncture, compression, etc., such as can arise from traumatic contact of a foreign object with any locus of or appurtenant to the head, neck, or vertebral column. Other forms of traumatic injury can arise from constriction or compression of CNS tissue by an inappropriate accumulation of fluid (for example, a blockade or dysfunction of normal cerebrospinal fluid or vitreous humor fluid production, turnover, or volume regulation, or a subdural or intracranial hematoma or edema). Similarly, traumatic constriction or compression can arise from the presence of a mass of abnormal tissue, such as a metastatic or primary tumor.

Spinal Cord Injury (SCI)

In one embodiment the injury to the CNS is Spinal Cord Injury (SCI) or myelopathy. SCI or myelopathy, is a disturbance of the spinal cord that results in loss of sensation and/or mobility. The two common types of spinal cord injury are due to trauma and disease. Traumatic injury can be due to automobile accidents, falls, gunshot, diving accidents inter alia, and diseases that can affect the spinal cord include polio, spina bifida, tumors, Amyotrophic Lateral Sclerosis (ALS), Multiple Sclerosis (MS) syringomyelia, transverse myelitis and Friedreich's ataxia.

In various embodiments, the otic pharmaceutical compositions of the invention are used for treating or preventing the damage caused by spinal-cord injury especially spinal cord trauma caused by motor vehicle accidents, falls, sports injuries, industrial accidents, gunshot wounds, spinal cord trauma caused by spine weakening (such as from rheumatoid arthritis or osteoporosis) or if the spinal canal protecting the spinal cord has become too narrow (spinal stenosis) due to the normal aging process, direct damage that occur when the spinal cord is pulled, pressed sideways, or compressed, damage to the spinal-cord following bleeding, fluid accumulation, and swelling inside the spinal cord or outside the spinal cord (but within the spinal canal). The otic pharmaceutical compositions of the invention are also used for treating or preventing the damage caused by spinal-cord injury due to disease such as polio or spina bifida.

Thus the present invention further provides a method of treating SCI in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat SCI. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with SCI. In certain embodiments inhibition of at least one gene confers upon the CNS neuroprotective properties.

In yet another aspect, the present invention provides a method of attenuating expression of a target mRNA in a subject suffering from SCI. In certain embodiments the at least one target mRNA is selected from an mRNA polynucleotide set forth in any one of SEQ ID NOS:1-293. In certain preferred embodiments the gene is selected from CASP3 (SEQ ID NO:24-25), TGM2 (SEQ ID NO:28-29), CAMK2A (SEQ ID NO:32-33), CBLN1 (SEQ ID NO:34), CDK5R1 (SEQ ID NO:35), MAPK10 (SEQ ID NO:43-46), NOS1 (SEQ ID NO:47), NTS (SEQ ID NO:51) and CASP2 (SEQ ID NO: 22-23).

Brain Injury

In one embodiment the injury to the CNS is brain injury. Brain injury such as trauma and stroke are among the leading causes of mortality and disability in the western world.

Traumatic brain injury (TBI) is one of the most serious reasons for hospital admission and disability in modern society. Clinical experience suggests that TBI may be classified into primary damage occurring immediately after injury, and secondary damage, which occurs during several days post injury. Current therapy of TBI is either surgical or else mainly symptomatic.

Thus the present invention further provides a method of treating brain injury in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat brain injury.

In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with brain injury. In certain embodiments inhibition of at least one gene confers upon the CNS neuroprotective properties.

In yet another aspect, the present invention provides a method of attenuating expression of a target mRNA in a subject suffering from brain injury. In certain embodiments the at least one target mRNA is selected from an mRNA polynucleotide set forth in any one of SEQ ID NOS:1-293.

Cancer in the Central Nervous System (CNS)

In various embodiments the otic pharmaceutical compositions of the invention are useful for treating neoplasms in the central nervous system (CNS).

In various embodiments the neoplasm in the CNS is selected from any intracranial tumor created by abnormal and uncontrolled cell division either in the brain itself or spread from cancers primarily located in other organs (i.e. metastatic tumors). In various embodiments the neoplasm in the CNS is created by abnormal proliferation of or in the, inter alia, neurons (e.g. Motor neuron, Purkinje neuron, GABAergic neuron, Multipolar neuron, Cerebellar neuron, Afferent neuron, Sensory neuron), glial cells (e.g. astrocytes, microglia, oligodendrocytes), ependymal cells, lymphatic tissue, blood vessels, cranial nerves, myelin-producing Schwann cells, meninges, skull, Striatum, Nucleus of stria terminalis, hypothalamus, pituitary gland and pineal gland.

The otic pharmaceutical compositions of the present invention are particularly useful in treating a subject suffering from or affected by or susceptible to intracranial glioma selected from, without being limited to, ependymoma, glioma, astrocytoma, oligodendroglioma and oligoastrocytoma. In further embodiments otic pharmaceutical compositions of the present invention are useful in treating a subject suffering Pilocytic astrocytoma of cerebellum or Oligodendroglioma of brain.

In some embodiments the neoplasm is a neural crest tumor such as e.g. cranial primitive neuroectodermal tumors (PNET). In various embodiments the otic pharmaceutical compositions of the present invention are useful in treating a subject suffering from a neoplasm selected from, without being limited to, Medulloblastoma of cerebellum, Neuroblastoma of brain, Glioblastoma multiforme of brain and Neurofibromatosis.

Intracranial Glioma

In one embodiment the neoplasm in the CNS is intracranial glioma (e.g. Pilocytic astrocytoma of cerebellum; Oligodendroglioma of brain; Glioblastoma multiforme of brain; Astrocytoma).

Astrocytoma

Astrocytoma is a glial tumor of the brain or spinal cord showing astrocytic differentiation. It includes the following clinicopathological entities: pilocytic astrocytoma, diffuse astrocytoma, anaplastic astrocytoma, pleomorphic xanthoastrocytoma, subependymal giant cell astrocytoma, and glioblastoma.

Thus the present invention further provides a method of treating astrocytoma in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat astrocytoma. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with astrocytoma. In certain embodiments the at least one target mRNA is selected from an mRNA polynucleotide set forth in any one of SEQ ID NOS:1-293. In certain preferred embodiments the gene is selected from CAMK2A (SEQ ID NO:32-33), CBLN1 (SEQ ID NO:34), SYT1 (SEQ ID NO:63-65) and GABRA1 (SEQ ID NO:36-42).

Pilocytic Astrocytoma of Cerebellum

In one embodiment the neoplasm is pilocytic astrocytoma of cerebellum—a WHO Grade 1 astrocytoma which arises in the cerebellum. The tumor is composed of spindle shaped cells with numerous collections of reddish astrocytic fibers called Rosenthal fibers. Over 80% or the cerebellar astrocytomas of childhood are pilocytic. Pilocytic astrocytomas may rarely occur in adults. They are usually treated by surgical resection and in most cases have a favorable prognosis.

Thus the present invention further provides a method of treating pilocytic astrocytoma of cerebellum in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat pilocytic astrocytoma of cerebellum. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with pilocytic astrocytoma of cerebellum.

In yet another aspect, the present invention provides a method of attenuating expression of a target mRNA in a subject suffering from pilocytic astrocytoma of cerebellum. In certain embodiments the at least one target mRNA is selected from an mRNA polynucleotide set forth in any one of SEQ ID NOS:1-293. In certain preferred embodiments the gene is selected from GABRA1 (SEQ ID NO:36-42), NOS1 (SEQ ID NO:47) and NRGN (SEQ ID NO:49-50).

Neurofibromatosis

In one embodiment the neoplasm is Neurofibromatosis. Neurofibromatosis is group of disorders characterized by an autosomal dominant pattern of inheritance with high rates of spontaneous mutation and multiple neurofibromas or neurilemmomas; neurofibromatosis 1 (generalized neurofibromatosis) accounts for approximately 95% of cases, although multiple additional subtypes (e.g., neurofibromatosis 2, neurofibromatosis 3, etc.) have been described.

Thus the present invention further provides a method of treating Neurofibromatosis in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat Neurofibromatosis. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the brain of the subject and associated with Neurofibromatosis.

In yet another aspect, the present invention provides a method of attenuating expression of a target mRNA in a subject suffering from Neurofibromatosis. In certain embodiments the chemically modified double stranded RNA inhibits expression of at least one gene expressed in the spinal cord of the subject. In certain embodiments the at least one target mRNA is selected from an mRNA polynucleotide set forth in any one of SEQ ID NOS:1-293. In one preferred embodiment the gene is NOS1 (SEQ ID NO:47).

Neurological Disorder

In various embodiments the otic pharmaceutical compositions of the invention are useful for treating neurological disorders.

In various embodiments the neurological disorder is selected from, without being limited to, stroke, stroke-like situations (e.g. cerebral, renal, cardiac failure), neuronal cell death, epilepsy, Parkinsonism, Gluten Ataxia, cerebral ischemia and cerebrovascular accident.

Epilepsy

In one embodiment the neurological disorder is epilepsy. Epilepsy is a group of disorders marked by problems in the normal functioning of the brain. These problems can produce seizures, unusual body movements, loss of consciousness or changes in consciousness, as well as mental problems or problems with the senses.

Thus the present invention further provides a method of treating epilepsy in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat epilepsy. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with epilepsy.

In yet another aspect, the present invention provides a method of attenuating expression of a target mRNA in a subject suffering from epilepsy. In certain embodiments the chemically modified double stranded RNA inhibits expression of at least one gene expressed in the spinal cord of the subject. In certain embodiments the at least one target mRNA is selected from an mRNA polynucleotide set forth in any one of SEQ ID NOS:1-293. In certain preferred embodiments the gene is selected from GABRA1 (SEQ ID NO:36-42) and MAPK10 (SEQ ID NO:43-46).

Cerebrovascular Disorders

In one embodiment the neurological disease is cerebrovascular disorder, Cerebrovascular accident is a sudden, nonconvulsive loss of neurological function due to an ischemic or hemorrhagic intracranial vascular event. In general, cerebrovascular accidents are classified by anatomic location in the brain, vascular distribution, etiology, age of the affected individual, and hemorrhagic vs. nonhemorrhagic nature (for additional information see Adams et al., Principles of Neurology, 6th ed, pp 777-810).

Cerebrovascular diseases occur predominately in the middle and late years of life. They cause approximately 200, 000 deaths in the United States each year as well as considerable neurological disability. The incidence of stroke increases with age and affects many elderly people, a rapidly growing segment of the population. These diseases cause either ischemia-infarction or intracranial hemorrhage.

Stroke

In another embodiment the neurological disorder is stroke. Stroke is an acute neurological injury occurring as a result of interrupted blood supply, resulting in an insult to the brain. Most cerebrovascular diseases present as the abrupt onset of focal neurological deficit. The deficit may remain fixed, or it may improve or progressively worsen, leading usually to irreversible neuronal damage at the core of the ischemic focus, whereas neuronal dysfunction in the penumbra may be treatable and/or reversible. Prolonged periods of ischemia result in frank tissue necrosis. Cerebral edema follows and progresses over the subsequent 2 to 4 days. If the region of the infarction is large, the edema may produce considerable mass effect with all of its attendant consequences.

Damage to neuronal tissue can lead to severe disability and death. The extent of the damage is primarily affected by the location and extent of the injured tissue. Endogenous cascades activated in response to the acute insult play a role in the functional outcome. Efforts to minimize, limit and/or reverse the damage have the great potential of alleviating the clinical consequences.

Thus the present invention further provides a method of treating cerebrovascular condition in a subject in need of treatment that comprises administering to the ear of the subject an otic pharmaceutical composition which comprises a therapeutically effective amount of at least one oligonucleotide compound, which inhibits expression of at least one gene expressed in the CNS of the subject in an amount effective to treat cerebrovascular condition. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with cerebrovascular condition.

In yet another aspect, the present invention provides a method of attenuating expression of a target mRNA in a subject suffering from cerebrovascular condition. In certain embodiments the at least one target mRNA is selected from an mRNA polynucleotide set forth in any one of SEQ ID NOS: 1-293. In certain preferred embodiments the gene is selected from MAPK10 (SEQ ID NO:43-46) and PDE4D (SEQ ID NO:58-60).

Parkinsonism

In one embodiment the neurological disorder is Parkinsonism—a group of disorders which feature impaired motor control characterized by bradykinesia, muscle rigidity; tremor; and postural instability. Parkinsonian diseases are generally divided into primary parkinsonism, secondary parkinsonism and inherited forms. These conditions are associated with dysfunction of dopaminergic or closely related motor integration neuronal pathways in the basal ganglia.

Thus the present invention further provides a method of treating parkinsonism in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat parkinsonism. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with parkinsonism.

In yet another aspect, the present invention provides a method of attenuating expression of a target mRNA in a subject suffering from parkinsonism. In certain embodiments the at least one target mRNA is selected from an mRNA polynucleotide set forth in any one of SEQ ID NOS:1-293. In one preferred embodiments the gene is MAPT (SEQ ID NO:4-7).

Gluten Ataxia (GA)

In one embodiment the neurological disorder is Gluten Ataxia (GA)-cerebellar dysfunction caused by sensitivity to gluten.

Thus the present invention further provides a method of treating GA in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat GA. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with GA.

In yet another aspect, the present invention provides a method of attenuating expression of a target mRNA in a subject suffering from GA. In certain embodiments the at least one target mRNA is selected from an mRNA polynucleotide set forth in any one of SEQ ID NOS:1-293. In one preferred embodiments the gene is TGM2 (SEQ ID NO:15-16).

Mood Disorders and Post-Traumatic Stress Disorder

In various embodiments the otic pharmaceutical compositions of the invention are useful for treating mood disorders (e.g. major depressive disorder and bipolar disorder) and Post-traumatic stress disorder.

Two groups of mood disorders are broadly recognized; the division is based on whether the person has ever had a manic or hypomanic episode:

Major Depressive Disorder commonly called Major Depression or Unipolar Depression;

Bipolar disorder, formerly known as "manic depression" and described by intermittent periods of manic and depressed episodes (and in some cases rapid cycling, mixed states, and psychotic symptoms).

Furthermore, diagnosticians recognize several subtypes of major depressive disorders, such as for example, melancholic depression, psychotic depression, catatonic depression, post-partum depression, seasonal affective disorder.

Dysthymia is a chronic, milder mood disturbance where a person reports a depressed mood almost daily over a span of at least two years. Dysthymic patients are vulnerable to secondary episodes of major depression (sometimes referred to as double depression).

Depressive Disorder Not Otherwise Specified (DD-NOS) is a classification used for depressive disorders that are impairing but do not fit any of the officially specified diagnoses. It includes the research diagnoses of Recurrent brief depression, and Minor Depressive Disorder. Recurrent brief depression (RBD) is distinguished from Major Depressive Disorder primarily by differences in duration. People with RBD have depressive episodes about once per month, with individual episodes lasting less than two weeks and typically less than 2-3 days. Minor Depression, refers to a depression that does not meet full criteria for major depression but in which at least two symptoms are present for two weeks.

In one embodiment the mood disorder is major depressive disorder. Thus the present invention further provides a method of treating major depressive disorder in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat major depressive disorder. In various embodiments the oligonucleotide compound is selected from the group consisting of an antisense, an unmodified double stranded RNA, a chemically modified double stranded RNA, an shRNA, an aptamer, a ribozyme or DNA compound. In preferred embodiments of the invention the oligonucleotide compound is chemically modified siRNA.

In certain embodiments the chemically modified double stranded RNA inhibits expression of at least one gene expressed in the CNS of the subject and associated major depressive disorder.

In yet another aspect, the present invention provides a method of attenuating expression of a target mRNA in a subject suffering from major depressive disorder. In certain embodiments the at least one target mRNA is selected from an mRNA polynucleotide set forth in any one of SEQ ID NOS: 1-293. In one preferred embodiments the gene is NRGN (SEQ ID NO:27).

In another embodiment the mood disorder is bipolar disorder. Thus the present invention further provides a method of treating bipolar disorder in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat bipolar disorder. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with bipolar disorder.

In yet another aspect, the present invention provides a method of attenuating expression of a target mRNA in a subject suffering from bipolar disorder. In certain embodiments the at least one target mRNA is selected from an mRNA polynucleotide set forth in any one of SEQ ID NOS:1-293. In one preferred embodiments the gene is SYT1 (SEQ ID NO:32).

Post-Traumatic Stress Disorder

In one embodiment the CNS disorder is post-traumatic stress disorder—acute, chronic, or delayed reactions to traumatic events such as military combat, assault, or natural disaster.

Thus the present invention further provides a method of post-traumatic stress disorder in a subject in need of treatment that comprises administering to the ear of the subject an otic pharmaceutical composition which comprises a therapeutically effective amount of at least one oligonucleotide, which inhibits expression of at least one target gene expressed in the CNS of the subject in an amount effective to treat post-traumatic stress disorder. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with post-traumatic stress disorder.

In yet another aspect, the present invention provides a method of attenuating expression of a target mRNA in a subject suffering from post-traumatic stress disorder. In certain embodiments the at least one target mRNA is selected from an mRNA polynucleotide set forth in any one of SEQ ID NOS:1-293. In one preferred embodiments the gene is NRGN (SEQ ID NO:27).

Other Diseases and Disorders of the CNS

In various embodiments the otic pharmaceutical compositions of the invention are useful in treating disease or disorder of the CNS, selected from, without being limited to, Supranuclear paralysis, Lymphocytic choriomeningitis, Niemann Pick disease (e.g. Niemann Pick disease Type C) and AF type amyloidosis (Familial neuropathic amyloidosis).

Lymphocytic Choriomeningitis

In one embodiment the CNS disease is Lymphocytic choriomeningitis—benign viral infection of meninges and central nervous system producing an infiltration of lymphocytes in the choroid plexus.

Thus the present invention further provides a method of treating Lymphocytic choriomeningitis in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to treat Lymphocytic choriomeningitis. In various embodiments the oligonucleotide compound is selected from the group consisting of an antisense, an unmodified double stranded RNA, a chemically modified double stranded RNA, an shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated Lymphocytic choriomeningitis.

In yet another aspect, the present invention provides a method of attenuating expression of a target mRNA in a subject suffering from Lymphocytic choriomeningitis. In certain embodiments the at least one target mRNA is selected from an mRNA polynucleotide set forth in any one of SEQ ID NOS:1-293. In one preferred embodiments the gene is CASP3 (SEQ ID NO:13-14).

AF Type Amyloidosis

In another embodiment the CNS disorder is AF type amyloidosis—a group of inherited disorders of the peripheral nervous system associated with the deposition of amyloid in nerve tissue. The different clinical types based on symptoms correspond to the presence of a variety of mutations in several different proteins including Transthyretin (Prealbumin); Apolipoprotein A-I; and Gelsolin.

Thus the present invention further provides a method of treating AF type amyloidosis in a subject in need of treatment that comprises administering to the ear of the subject an otic pharmaceutical composition which comprises a therapeutically effective amount of at least one oligonucleotide compound, which inhibits expression of at least one target gene expressed in the CNS of the subject in an amount effective to treat AF type amyloidosis. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with AF type amyloidosis.

In yet another aspect, the present invention provides a method of attenuating expression of a target mRNA in a subject suffering from AF type amyloidosis. In certain embodiments the at least one target mRNA is selected from an mRNA polynucleotide set forth in any one of SEQ ID NOS: 1-293. In one preferred embodiments the gene is TTR (SEQ ID NO:33).

Neuroprotection

In further embodiments, the otic pharmaceutical compositions of the invention are directed to providing neuroprotection, or to provide cerebroprotection, and to attenuating acute or chronic neuronal damage in diseases, disorders or injury of the CNS.

Thus the present invention further provides a method of conferring neuroprotection to cells and/or tissues in a subject in need of treatment that comprises administering to the canal of the subject's ear an otic pharmaceutical composition which comprises a therapeutically effective amount of at least one oligonucleotide compound, which inhibits expression of at least one target gene expressed in the CNS of the subject in an amount effective to confer upon the cells of the CNS neuroprotective properties. In various embodiments the oligonucleotide compound is selected from the group consisting of an antisense, an unmodified double stranded RNA, a chemically modified double stranded RNA, a shRNA, an aptamer, a ribozyme or a DNA compound. In preferred embodiments of the invention the oligonucleotide compound is chemically modified siRNA.

In certain embodiments the chemically modified double stranded RNA inhibits expression of at least one gene expressed in the CNS of the subject and associated with an acute or a chronic neuronal damage in diseases, disorders or injury of the CNS.

In yet another aspect, the present invention provides a method of a method of conferring neuroprotection to cells and/or tissues in a subject in need of treatment. In certain embodiments the at least one target mRNA is selected from an mRNA polynucleotide set forth in any one of SEQ ID NOS: 1-293. In some embodiments the siRNA targets RhoA (SEQ ID NO:110), APP (SEQ ID NOS:1-5), CASP2 (SEQ ID NOS:22-23), FAS (SEQ ID NOS:1524-160), FASLG (SEQ ID NO:161), NOS1 (SEQ ID NO:47). In yet another aspect, the present invention provides a method of a method of reducing neurotoxicity in cells and/or tissues in a subject in need of treatment. In certain embodiments the at least one target mRNA is selected from an mRNA polynucleotide set forth in any one of SEQ ID NOS:1-293. In some embodiments the siRNA targets RhoA (SEQ ID NO:110), APP (SEQ ID NOS: 1-5), CASP2 (SEQ ID NOS:22-23), FAS (SEQ ID NOS: 1524-160), FASLG (SEQ ID NO:161), NOS1 (SEQ ID NO:47).

The invention has been described in an illustrative manner, and it is to be understood that the terminology used is intended to be in the nature of words of description rather than of limitation.

Many modifications and variations of the present invention are possible in light of the above teachings. It is, therefore, to be understood that within the scope of the appended claims, the invention can be practiced otherwise than as specifically described.

Throughout this application, various publications, including United States Patents, are referenced by author and year and patents by number. The disclosures of these publications and patents and patent applications in their entireties are hereby incorporated by reference into this application in order to more fully describe the state of the art to which this invention pertains.

The present invention is illustrated in detail below with reference to examples, but is not to be construed as being limited thereto.

Citation of any document herein is not intended as an admission that such document is pertinent prior art, or considered material to the patentability of any claim of the present application. Any statement as to content or a date of any document is based on the information available to applicant at the time of filing and does not constitute an admission as to the correctness of such a statement.

EXAMPLES

Without further elaboration, it is believed that one skilled in the art can, using the preceding description, utilize the present invention to its fullest extent. The following preferred specific embodiments are, therefore, to be construed as merely illustrative, and not limitative of the claimed invention in any way.

General Methods—Molecular Biology and Immunoassays

Standard molecular biology protocols known in the art not specifically described herein are generally followed essentially as in Sambrook et al., *Molecular cloning: A laboratory manual*, Cold Springs Harbor Laboratory, New-York (1989, 1992), and in Ausubel et al., *Current Protocols in Molecular Biology*, John Wiley and Sons, Baltimore, Md. (1988), and as in Ausubel et al., *Current Protocols in Molecular Biology*, John Wiley and Sons, Baltimore, Md. (1989) and as in Perbal, *A Practical Guide to Molecular Cloning*, John Wiley & Sons, New York (1988), and as in Watson et al., *Recombinant DNA*, Scientific American Books, New York and in Birren et al (eds) *Genome Analysis: A Laboratory Manual Series*, Vols. 1-4 Cold Spring Harbor Laboratory Press, New York (1998) and methodology as set forth in U.S. Pat. Nos. 4,666,828; 4,683, 202; 4,801,531; 5,192,659 and 5,272,057 and incorporated herein by reference. Polymerase chain reaction (PCR) was carried out as discussed in *PCR Protocols: A Guide To Methods And Applications*, Academic Press, San Diego, Calif. (1990). In situ PCR in combination with Flow Cytometry (FACS) can be used for detection of cells containing specific DNA and mRNA sequences (Testoni et al., Blood 1996, 87:3822.) Methods of performing qPCR and RT-PCR are well known in the art.

Standard organic synthesis protocols known in the art not specifically described herein are generally followed essentially as in *Organic syntheses: Vol.* 1-79, editors vary, J. Wiley, New York, (1941-2003); Gewert et al., *Organic synthesis workbook*, Wiley-VCH, Weinheim (2000); Smith & March, *Advanced Organic Chemistry*, Wiley-Interscience; 5th edition (2001).

Standard medicinal chemistry methods known in the art not specifically described herein are generally followed essentially as in the series "Comprehensive Medicinal Chemistry", by various authors and editors, published by Pergamon Press.

In general, ELISA is a preferred immunoassay. ELISA assays are well known to those skilled in the art. Both polyclonal and monoclonal antibodies can be used in the assays. Where appropriate other immunoassays, such as radioimmunoassays (RIA) can be used as are known to those in the art. Available immunoassays are extensively described in the patent and scientific literature. See, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521 as well as Sambrook et al, *Molecular Cloning: A Laboratory Manual*, Cold Springs Harbor, N.Y., 1989.

Sequence Listing

The Sequence Listing filed electronically herewith is hereby incorporated by reference in its entirety (File Name: 206_PCT1_ST25.txt; Date Created: Dec. 9, 2010; File Size: 2 MB)

siRNA Activity

In general, about $1.5\text{-}2\times10^5$ tested cells (HeLa cells and/or 293T cells for siRNA targeting human genes and NRK52 (normal rat kidney proximal tubule cells) cells and/or NMuMG cells (mouse mammary epithelial cell line) for siRNA targeting the rat/mouse gene) are seeded per well in 6 wells plate (70-80% confluent).

About 24 hours later, cells are transfected with siRNA compounds using the Lipofectamine™ 2000 reagent (Invitrogen) at final concentrations of 5 nM or 20 nM. The cells are incubated at 37° C. in a $CO_2$ incubator for 72 h.

As positive control for transfection PTEN-Cy3 labeled siRNA compounds are used. Various chemically modified siRNA compounds are tested for activity. GFP siRNA compounds are used as negative control for siRNA activity.

At 72 h after transfection cells are harvested and RNA is extracted from cells. Transfection efficiency is tested by fluorescent microscopy.

The percent of inhibition of gene expression using specific preferred siRNA structures is determined using qPCR analysis of a target gene in cells expressing the endogenous gene.

In general, the siRNAs having specific sequences that are selected for in vitro testing are specific for human and a second species such as non-human primate, rat or rabbit genes.

Serum Stability Experiments

Chemically modified siRNA compounds according to the present invention are tested for duplex stability in human serum, as follows:

siRNA molecules at final concentration of 7 uM are incubated at 37° C. in 100% human serum (Sigma Cat# H4522). (siRNA stock 100 uM diluted in human serum 1:14.29).

5 ul are added to 15 ul 1.5×TBE-loading buffer at different time points (0, 30 min, 1 h, 3 h, 6 h, 8 h, 10 h, 16 h and 24 h). Samples are immediately frozen in liquid nitrogen and were kept at −20° C.

Each sample is loaded onto a non-denaturing 20% acrylamide gel, prepared according to methods known in the art. The oligos are visualized with ethidium bromide under UV light.

Example 1

Non-Invasive (Ear Drops) Delivery of siRNA Comprising Otic Pharmaceutical Compositions to the CNS in Mice Assessed by Stem-Loop qPCR Study design The study included 8 experimental groups with 6 mice each as described in Table 1. Animals from experimental groups I-IV: were treated with a single dose of otic pharmaceutical composition comprising siRNA compound that targets the mRNA of the CASP2 gene.

TABLE 1

Study Design

| Group No.: | siRNA to CASP2 (REAC) | Dose/volume of 20% glycerol | Termination Time Point (hours or days) | Analysis | Group Size |
|---|---|---|---|---|---|
| I | Yes | 150 µg/3 µl | 6 hours | qPCR | 6 |
| II | Yes | 150 µg/3 µl | 1 day | qPCR | 6 |
| III | Yes | 150 µg/3 µl | 4 days | qPCR | 6 |
| IV | Yes | 150 µg/3 µl | 7 days | qPCR | 6 |
| V | No | 3 µl vehicle | 1 day | qPCR | 6 |
| VI | No | 3 µl vehicle | 4 day | qPCR | 6 |
| VII | No | Normal | 1 day | qPCR | 6 |
| VIII | No | Normal | 4 days | qPCR | 6 |

The chemically modified siRNA compound (CASP2 siRNA, designated as siCASP2 or CASP2_4_S510 siRNA) that was used in the preparation of the otic pharmaceutical composition utilized in this study is a proprietary 19-mer blunt-ended duplex having two separate strands, with an antisense strand (AS, guide strand) comprising unmodified ribonucleotides at positions 1, 3, 5, 7, 9, 10, 12, 14, 16 and 18 (capital letters), and 2'OMe sugar modified ribonucleotides at positions 2, 4, 6, 8, 11, 13, 15, 17 and 19 (lower case letters); and a sense strand (SEN, passenger strand) comprising unmodified ribonucleotides and an L-deoxyribonucleotide at position 18 (bold underlined) and an inverted deoxyabasic moiety (iB) at the 5' terminus, as depicted:

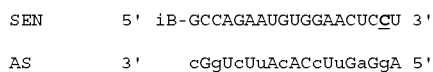

The siCASP2 compound was formulated for eardrop administration in glycerol.

Animals of experimental Groups I-IV were treated with a dose of 150 µg of siRNA compound in 3 µl 20% glycerol, delivered by eardrop (ErD) to the right external auditory canal (REAC) of the animal (experimental Groups I-IV). Animals of experimental Groups V and VI (vehicle control) were treated REAC with 3 µl of 20% glycerol and experimental Groups VII and VIII were used as intact normal control.

Tissue Collection:

Brain: Whole brains were harvested and sagittally dissected into 2 parts, left and right. The dissected brain parts were snap frozen in liquid nitrogen, separately, in properly labeled tubes and transferred for extraction of total RNA and further analysis. Both brain parts (treated and contralateral sides) were weighed prior to processing to obtain the RNA quantity/mg tissue in order to be able to compare to plasma siRNA concentration.

Spinal Cord: Spinal columns were harvested and transversally dissected (from cervical to sacral regions at the lower level of the rib cage) into 2 segments, thereafter spinal cord was harvested from each of the segments and snap frozen in liquid nitrogen, separately, in properly labeled tubes in liquid nitrogen and transferred for RNA extraction and further analysis.

Blood: Peripheral blood was collected by cardiac puncture from each animal upon termination, in EDTA collection tubes. It was centrifuged (5 min/5000 rpm, RT) to separate plasma. Plasma was used for siRNA detection.

Eyes (Left and Right): Eyes were enucleated; retinas were harvested and snap frozen in liquid nitrogen, transferred for RNA extraction and further siRNA detection analysis by qPCR.

Materials and Methods

RNA Purification

Brain RNA:

Brain was weighed prior to processing to obtain the RNA quantity/mg tissue in order to be able to compare to plasma siRNA concentration. RNA was extracted from the whole frozen tissue segments.

RNA was extracted using the EZ-RNA II kit (Biological Industries Cat#20-410-100). To avoid the degradation of the RNA during the weighing, 2.5 ml solution A (EZ-RNA II) was added to the tube containing the Brain tissue, homogenization of the tissues was done by the polytrone and then each tube was weighed keeping it at 4° C. as much as possible. The weight of the tissue was calculated by subtraction the weight of a similar tube contains the same volume of solution A. In order to avoid contamination of siRNA, RNA extraction from the control groups (Groups V-VIII) was done separately from all the siRNA groups (Groups I-IV).

The final yields and spectral characteristics of the brain RNA were summarized. The quality of RNA preparations was checked by agarose gel electrophoresis.

Spinal Cord RNA:

RNA was extracted from the whole frozen tissue segments. Total RNA was extracted from each sample using EZ-RNAII kit (Biological Industries Cat#20-410-100)—with purification on Norgen RNA Clean-Up and concentration Kit (Norgen Cat no. 23600) according to Norgen kit protocol for "RNA Clean-up and Concentration from Phenol/Guanidine-Based RNA Isolation Methods".

The final yields and the spectral characteristics of the RNA were summarized. The quality of the RNA preparations was checked by agarose gel electrophoresis.

Plasma RNA:

1 µl of plasma was taken for direct qPCR.

Retina RNA:

RNA was prepared from left and right eye retina samples using a starting volume of 0.7 ml solution A (EZ-RNA II) and extracted using the EZ-RNAII kit (using a double extraction of the organic phase). Linear acrylamide was added as carrier. cDNA was prepared from all the above samples for the detection of siCASP2. Both batches of cDNA were prepared using the stem-loop method for detection. Initial RNA concentration of cDNA, was 1 µg in a 10 µl reaction mix.

Results

TABLE 2

Mean quantities of siRNA as found in tissues/fluids tested

| Tissue/Fluid | siRNA quantity unit | 6 hours | 1 day | 4 days | 7 days | Background |
|---|---|---|---|---|---|---|
| Plasma | fmole/1 µl Plasma | 0.38 | 0.04 | 0.01 | 0.02 | 0.03 |
| Brain* | fmole/1 µg RNA | 20.5 | 1.7 | 0.2 | 0.08 | 0.05 |
| SC** | fmole/1 µg RNA | 13.3 | 3.41 | 0.27 | 0.18 | 1 |
| Retina*** | fmole/1 µg RNA | 4.01 | 1.69 | 0.24 | 0.37 | 0.006 |

*Brain result is the average of Left and Right parts
**SC result is the average of segment 1 & 2
***Retina result is the average of Left and Right eyes siCASP2 was detected after 6 hours and 24 hours (levels above background) in Brain, Spinal Cord (SC), Plasma and Retina. Table 2 above summarizes the mean quantities found in tissues/fluids tested.

Values below background level are shadowed.

This study showed efficient delivery of non-invasively administered siRNA (siCASP2) formulated in an otic composition, to the brain, the spinal cord and the retina. The siRNA compound was detectable in the brain up to 7 days post-administration and in the spinal cord up to 1 day post administration.

Example 2

Influence of Anesthesia on Delivery of siRNA, Non-Invasively Administered as an Otic Pharmaceutical Composition, to the Brain and Retina in Mice, as Assessed by Stem-Loop qPCR The Objective of the Study:

To investigate time course and detect siRNA accumulation in CNS (brain, spinal cord and retina) after administration of eardrops using different anesthesia modes.

Experimental Design

The aim of this study was to assess the effects of different anesthesia modes (Isoflurane treated or Equithesine treated vs. non anesthetized animals) on siRNA levels detected in the CNS (brain, spinal cord and retina) and Systemic blood (plasma) following single application of a siCASP2 compound administered as eardrops. The study included 6 experimental groups (10 mice each) of different anesthesia modes for a single siCASP2 eardrop application (Groups I-III), vehicle eardrop application (Groups IV-V) or intact control (Groups VI) as described in Table 3 hereinbelow.

The CASP2 siRNA compound used in this study was the chemically modified siRNA compound siCASP2 described in Example 1 hereinabove.

TABLE 3

| Study Design | | | | | |
|---|---|---|---|---|---|
| Group No.: | Dose/volume 20% glycerol | Delivery mode | Termination time point | Mode of Anesthesia | Group Size |
| I | 150 µg/3 µl | Single | 6 hours | Equithesine | 10 |
| II | 150 µg/3 µl | Single | 6 hours | Isoflurane | 10 |
| III | 150 µg/3 µl | Single | 6 hours | None | 10 |

TABLE 3-continued

| Study Design | | | | | |
|---|---|---|---|---|---|
| Group No.: | Dose/volume 20% glycerol | Delivery mode | Termination time point | Mode of Anesthesia | Group Size |
| IV | Vehicle | Single | 6 hours | Isoflurane | 10 |
| V | Vehicle | Single | 6 hours | Equithesine | 10 |
| VI | INTACT | N/A | 6 hours | None | 10 |

Animals from all experimental groups were treated with single application of otic composition comprising siCASP2 in glycerol formulation, eardrop/mouse/time point: at a dose of 150 µg/3 µl 20% Glycerol, eardrop (ErD) route: REAC (right external auditory canal).

Animals from experimental vehicle control groups IV and V were treated using a single application REAC (3 µl) of 20% glycerol, by ErD. Experimental group VI was used as intact normal control.

Anesthesia:

Mice were anesthetized according to the study design as follows (all animals were kept immobilized, on the contralateral side of eardrop administration, for 1 hour):

Equithesine: I.P.; 4 ml/kg.

Isoflurane: single or multiple treatments. Isoflurane special circuit system (Stoelting, USA) using 3-4.5% Isoflurane in $O_2$ at 600-800 ml/min $O_2$ flow rate exposure time 60 minutes.

Non anesthetized animals: were immobilized using special restrainer system (DecapiCone-Braintree Scientific, Inc. Cat# MDC-200)

Right External Auditory Canal (REAC) Eardrops (ErD) Delivery:

A 3 µl sample volume (warm (37° C.) 20% glycerol based otic composition) was slowly instilled into the REAC according to the study design. During and after REAC instillations, mice were kept on the contra lateral side for 1 hour, and were returned to their cages after they regained consciousness.

Body Weight Follow Up:

Animals from repeated treatment groups were observed and monitored for their general health status and body weight.

Scheduled Euthanasia:

Mice from all groups were deeply anesthetized as described and euthanized according to the study design (Table 3, Time point termination).

Tissue Collection:

Systemic Blood:

Systemic blood was collected, by cardiac puncture, from each animal upon termination, in EDTA collection tubes, and centrifuged (5 min/5000 rpm, RT) to separate plasma. Plasma was used for siRNA detection.

Brain:

Whole brains were harvested; snap frozen in liquid nitrogen in properly labeled tubes and transferred for extraction of total RNA and further analysis by qPCR.

Spinal Cord:

Spinal columns were harvested and spinal cord was harvested using the saline extrusion method and snap frozen in liquid nitrogen in properly labeled tubes.

Inner Ear:

External Base of Skull (Basis Cranii externa) was harvested, fixed in 10% neutral buffered formalin for 48 hours, followed by decalcification, paraffin embedding and sectioning of the right and left temporal bones and ISH analysis.

Eyes (Left and Right):

Eyes were enucleated; retinas were harvested and snap frozen in liquid nitrogen, for RNA extraction and further siRNA detection analysis by qPCR.

Evaluation

Detection of siCASP2 siRNA Delivery into Brain, Spinal Cord and Retina, by qPCR:

RNA was extracted from the spinal cord segments using the EZ-RNAII kit followed by purification on Norgen columns, and from the brain and the retinas by EZ RNA kit only. The extracted RNA was transferred for cDNA preparation and siRNA quantification by Stem-Loop qPCR. siRNA quantity in samples was determined by qPCR according to Real Time RT-PCR Procedure using SYBR Green method on Applied Biosystem 7300 PCR System. miRNA was used as a reference.

Results:

siCASP2 was detectable in the brain and the retina and quantities were higher in the retina than in the brain. In the brain, Equithesine anesthetized group showed a higher amount of siCASP2 than Isoflurane anesthetized group. In the retina; non-anesthetized and Equithesine anesthetized groups showed higher amounts of siCASP2, than the Isoflurane anesthetized group.

Example 3

The Effect of Glycerol Concentration on Non-Invasive Delivery of an Otic Composition Comprising siRNA to the Inner Ear and the CNS in Mice, as Assessed by Stem-Loop qPCR and In-Situ Hybridization Objective The aims of the study was to investigate the influence of glycerol concentration in otic (eardrop) formulation, on siRNA delivery to (i) mouse inner ear tissues, as determined by in-situ hybridization (ISH); and (ii) mouse brain, plasma and spinal cord, as determined by qPCR.

Test Article:

siCASP2 described in Example 1 hereinabove), that targets the mRNA of the CASP2 gene, formulated as 50 mg/ml siCASP2 solution in glycerol or in PBS.

Stock Solution of the siCASP2:

Under sterile conditions, 300 mg dry siCASP2 was dissolved in 15 ml of sterile water for injection (Norbrook), to achieve a clear 20 mg/ml solution. The solution was stored at −80° C. until use.

Otic Compositions:

1. 50 mg/ml siCASP2 solution in PBS: 1650 of 20 mg/ml stock solution of siCASP2 was ethanol precipitated and air-dried to obtain 3.3 mg dry material which was dissolved in 66 µl of PBS (1×) to obtain a final concentration of 50 µg/µl.

2. 50 mg/ml siCASP2 solution in 3% Glycerol: 1650 of 20 mg/ml stock solution of siCASP2_4_S510 siRNA was ethanol precipitated and air-dried to obtain 3.3 mg dry material which was dissolved in 3% Glycerol solution to a final volume of 66 µl.

3. 50 mg/ml siCASP2 solution in 10% Glycerol: 165 µl of 20 mg/ml stock solution of CASP2_4_S510 siRNA was ethanol precipitated and air-dried to obtain 3.3 mg dry material which was dissolved in 10% Glycerol solution to a final volume of 66 µl.

4. 50 mg/ml siCASP2_4 in 20% Glycerol: 165 µl of 20 mg/ml stock solution of CASP2_4_S510 siRNA was ethanol precipitated and air-dried to obtain 3.3 mg dry material which was dissolved in 20% Glycerol solution to a final volume of 66 µl.

Control Articles (Including Positive/Negative Controls and Vehicle):

4 ml 100% Glycerol stock were diluted with 6 ml water for injection (Norbrook), stirred for 1 h and filtered through sterile 0.45 µm filter. This solution was used for preparation of a range of glycerol concentrations for preparation of the siRNA comprising otic compositions.

For 3% glycerol solution: 30 µl of stock Glycerol (40%) solution were diluted with 370 µl WFI (water for injection) to yield a 3% Glycerol solution (400 µl).

For 10% glycerol solution: 50 µl of stock Glycerol (40%) solution were diluted with 150 µl WFI to yield a 10% Glycerol solution (200 µl).

For 20% glycerol solution: 50 µl from stock Glycerol (40%) solution were diluted with 50 µl WFI to yield a 20% Glycerol solution (100 µl).

Vehicle: PBS sterile solution in pyrogen free water was prepared by adding 450 µl of water for injection (Norbrook) to 50 µl of 10×PBS.

Test System

Animals:

Species: Mice; Strain: C57BL; Age: 8-10 weeks

Body Weight Range: 23-27 gr; Sex: Males

Group Size: N=6; Total number of animals: 90

Animal Husbandry: Diet: Animals were provided an ad libitum commercial rodent diet, and free access to drinking water.

Environment: Following an acclimatization of at least 5 days, all the animals were confined in a limited access facility with environmentally-controlled housing conditions throughout the entire study period, and maintained in accordance with approved standard operating procedures (SOPs). Automatically controlled environmental conditions were set to maintain temperature at 20-24° C. with a relative humidity (RH) of 30-70%, a 12-hr light/12-hr dark cycle and 15-30 air changes/hr in the study room. Temperature, RH and the light cycle were monitored by the control computer throughout the study period.

Experimental Design

The study included 15 experimental groups as described in Table 4.

TABLE 4

Study Design

| Group No.: | siRNA Type | Dose Regime [µg siRNA/µl solution] (REAC) | Termination Time post ErD Application (hours/days) | Group Size |
|---|---|---|---|---|
| I | siCASP2 | 150 µg/3 µl PBS | 6 hours | 6 |
| II | siCASP2 | 150 µg/3 µl 3% Glycerol | 6 hours | 6 |
| III | siCASP2 | 150 µg/3 µl 10% Glycerol | 6 hours | 6 |
| IV | siCASP2 | 150 µg/3 µl 20% Glycerol | 6 hours | 6 |
| V | siCASP2 | 150 µg/3 µl PBS | 1 day | 6 |
| VI | siCASP2 | 150 µg/3 µl 3% Glycerol | 1 day | 6 |
| VII | siCASP2 | 150 µg/3 µl 10% Glycerol | 1 day | 6 |
| VIII | siCASP2 | 150 µg/3 µl 20% Glycerol | 1 day | 6 |
| IX | siCASP2 | 150 µg/3 µl PBS | 4 days | 6 |
| X | siCASP2 | 150 µg/3 µl 3% Glycerol | 4 days | 6 |
| XI | siCASP2 | 150 µg/3 µl 10% Glycerol | 4 days | 6 |
| XII | siCASP2 | 150 µg/3 µl 20% Glycerol | 4 days | 6 |
| XIII | None (Vehicle PBS) | 3 µl PBS | 1 day | 6 |
| XIV | None (Vehicle Glycerol) | 3 µl 20% Glycerol | 1 day | 6 |
| XV | None (Intact) | N/A | | 6 |

Anesthesia:

Mice were anesthetized with 4 ml/kg body weight of Equithesine (i.p.)

Right External Auditory Canal (REAC) Eardrops (ErD) Delivery:

A 3 µl sample volume was slowly instilled into the external REAC, using a blunt pipette tip. This volume was delivered to all mice from groups I-XIV according study design in Table 4. During and after REAC instillations, mice were kept on the contra lateral side for 1 hour, and were returned to their cages after they regained consciousness.

Scheduled Euthanasia:

Mice from all groups were deeply anesthetized and euthanized according to the study design (Table 4, Time point termination).

Tissue Collection

All euthanized mice were decapitated.

Blood:

Systemic blood was collected by cardiac puncture, from each animal, upon termination, in EDTA collection tubes. It was centrifuged (5 min/5000 rpm, RT) to separate plasma. Plasma was used for siRNA detection.

Brain:

Whole brains were harvested and snap frozen in liquid nitrogen in properly labeled tubes and transferred for extraction of total RNA and further analysis by qPCR. Whole brain was weighed prior to processing to obtain the RNA quantity/mg tissue in order to be able to compare to plasma siRNA concentration.

Inner Ear:

External Base of Skull (Basis Cranii externa) was (after whole brain harvesting) fixed in 10% neutral buffered formalin for 24-48 hours, followed by decalcification, paraffin embedding and sectioning of the right temporal bone as preparation for ISH analysis. Left temporal bones were used as additional control (if need).

Spinal Cord:

Spinal columns were harvested and transversally dissected (from cervical to sacral regions at the lower level of the rib cage) into 2 segments, thereafter spinal cord was snap frozen in liquid nitrogen in properly labeled tubes and transferred for RNA extraction. Spinal cord was weighed prior to processing, to obtain the RNA quantity/mg tissue, and analyzed.

Eyes (Left and Right):

Eyes were enucleated; retinas were harvested and snap frozen in liquid nitrogen, transferred for RNA extraction and further siRNA detection analysis by qPCR.

Evaluation siCASP2 Quantification in Brain, Plasma, Spinal Cord and Retinas was Performed by qPCR:

RNA was extracted from the entire tissue (with no exception). From the spinal cord segments RNA was extracted with EZ RNA kit followed by purification on Norgen columns, and from the brain segments and the retinas by EZ RNA kit only. RNA was transferred for cDNA preparation and siRNA quantification.

siRNA quantity in samples was determined by qPCR using SYBR Green method on Applied Biosystem 7300 PCR System. miRNA was used as a reference.

siCASP2 detection in inner ear by In-Situ Hybridization (ISH): ISH was performed using $^{33}$P-labeled probe.

Results

The study showed the effect of glycerol concentration on efficient delivery of siRNA (siCASP2) formulated as eardrop otic pharmaceutical composition, to the brain, retina and the spinal cord. A significant amount of siRNA was detected in the brain, retina and spinal cord after 6 hours (up to about 20 fmol/ug RNA). In the brain there was significant above baseline detection of siRNA up to 4 days post administration of ear drops.

ISH:

The brain from the intact animals showed no hybridization signal. In treated animals siRNA was detected at six hours in the spinal trigeminal tract, principal sensory nucleus, vestibule-cochlear nerve, cerebral ventricle and adjacent tissue (hippocampus, striatum and thalamus).

Example 4

In-Situ Hybridization Assessment of Non Invasive Delivery of siRNA to the CNS and Inner Ear in Mice, by Otic and by Intranasal Administration Objective The objective of the study was to assess by In-Situ Hybridization (ISH) and qPCR the distribution of siRNA non-invasively administered in an otic composition and delivered to the inner ear and the central nervous system (CNS) in mice.

Test Article:

Proprietary siRNA compound (CASP2_4_S510 siRNA), described in Example 1 hereinabove), that targets CASP2, formulated in an otic composition comprising 50 mg/ml siCASP2 solution in 20% glycerol or 50 mg/ml siCASP2 solution in PBS.

Description of the Test Material:

Under sterile conditions, dry siRNA was dissolved in 15 ml of sterile water for injection (Norbrook), to achieve a clear 20 mg/ml solution. The solution was stored at −80° C. until use. Ethanol precipitated and air-dried 2400 of 20 mg/ml stock solution of siCASP2 to obtain 4.8 mg dry siRNA. siCASP2 was then dissolved in 20% glycerol solution to a volume of 96 µl (50 mg/ml) and aliquoted into 4 tubes of 24 µl.

Control Article (Including Positive/Negative Controls and Vehicle):

Vehicle: 20% sterile glycerol solution in pyrogen free water 50 mg/ml siCASP2 solution in PBS Vehicle PBS: Formulation prepared from 10×PBS by dilution 1:9 in water for injection.

Test System

Animals:

Species: Mice Strain: C57BL

Age: 8-10 weeks; Body Weight Range: 23-27 gr; Sex: Males Group Size: N=3, 6; Total number of animals: 51

Animal Husbandry Diet: Animals were provided an ad libitum commercial rodent diet and free access to drinking water. Environment: Following acclimatization of at least 5 days all the animals were confined in a limited access facility with environmentally controlled housing conditions throughout the entire study period. Automatically controlled environmental conditions were set to maintain temperature at 20-24° C. with a relative humidity (RH) of 30-70%, a 12-hr light/12-hr dark cycle and 15-30 air changes/hr in the study room. Temperature, RH and the light cycle were monitored by the control computer throughout the study period.

Experimental Design

General: The study included 9 experimental groups as described in Table 5. Animals from experimental group I and II were treated with single administration of siCASP2 comprising glycerol based otic composition, administered as eardrops/mouse/time point: at a dose of 150 µg of siCASP2 in 3 µl of 20% glycerol otic composition, delivered by eardrop (ErD); route: to REAC (right external auditory canal). Experimental groups III-VI were treated with single application of siCASP2 in PBS based otic composition (50 mg/ml siCASP2 solution in PBS). Intranasal instillation/mouse/time point: at a dose of 150 µg siCASP2/3 µl PBS, delivered by intranasal administration (IN) (right nostril). Experimental groups VII and VIII were instilled with a single application of ErD or IN as described in the Table 5 and were used as the vehicle controls for the ISH and qPCR analysis. Experimental group IX was used as an intact normal control for ISH and qPCR analysis.

Anesthesia:

Mice were anesthetized with 4 ml/kg body weight of Equithesine (i.p.). Right external auditory canal (REAC) eardrops ErD delivery (experimental groups I, II and VII): A 3 µl sample volume (warm (37° C.) 20% glycerol based eardrops) were slowly instilled into the external REAC, using a blunt pipette tip according to study design. During and after REAC instillations, mice were kept on the contra lateral side for 1 hour, and returned to their cages after they regained consciousness.

Intranasal (IN) Delivery (Experimental Groups III-VI and VIII):

A 3 µl sample volume was instilled into the right nostril using a blunt pipette tip according to study design. During and after IN instillations, the mice were observed for possible respiratory abnormalities.

Scheduled Euthanasia:

Mice from all groups were deeply anesthetized (I.P Equithesine, 4 ml/kg) and euthanized according to the study design (Table 5, Time point termination).

Termination Step:

Animals from Experimental Groups I-IV and VII-IX for ISH Analysis:

Euthanasia was accomplished by cardiac puncture followed by transcardial perfusion with 10% neutral buffered formalin for 3-5 minutes with the standard peristaltic pump rate (10-20 rpm/min).

Animals from Experimental Groups V-IX for qPCR Analysis:

Euthanasia was accomplished according to the study design.

Tissue Collection:

Blood: Systemic blood was collected by cardiac puncture from each animal (V-IX groups for qPCR analysis), upon termination, in EDTA collection tubes, and centrifuged (5 min/5000 rpm, RT) to separate plasma. Plasma was used for siRNA detection.

Brain:

For ISH analysis: Whole brains were harvested after decapitation and transferred in 10% NBF for in-situ hybridization of siRNA. For qPCR analysis: Whole brains were harvested and snap frozen in liquid nitrogen in properly labeled tubes and transferred for extraction of total RNA and further analysis by qPCR.

Spinal Column:

For ISH analysis: Spinal columns was harvested. Spinal cord slices were decalcified (up to 5 days), embedded in paraffin and sectioned. For qPCR analysis: Spinal columns were harvested, thereafter spinal cord was snap frozen in liquid nitrogen in properly labeled tubes and subjected to RNA extraction.

Inner ear for ISH analysis: (experimental groups I, II, VII and IX): External Base of Skull (Basis Cranii externa) was (after whole brain harvesting) post fixed in 10% neutral buff-

TABLE 5

Study Design

| Group No.: | SiRNA | Delivery Route | Dose/volume | Formulation Type | Termination (hours) | Analysis | Group Size |
|---|---|---|---|---|---|---|---|
| I | siCASP2 | REAC | 150 µg/3 µl | 20% glycerol | 6 | ISH | 3 |
| II | siCASP2 | REAC | 150 µg/3 µl | 20% glycerol | 24 | ISH | 3 |
| III | siCASP2 | IN | 150 µg/3 µl | PBS | 6 | ISH | 3 |
| IV | siCASP2 | IN | 150 µg/3 µl | PBS | 24 | ISH | 3 |
| V | siCASP2 | IN | 150 µg/3 µl | PBS | 6 | qPCR | 6 |
| VI | siCASP2 | IN | 150 µg/3 µl | PBS | 24 | qPCR | 6 |
| VII | None | REAC | 3 µl | 20% glycerol | 6 | qPCR/ISH | 6/3 |
| VIII | None | IN | 3 µl | PBS | 6 | qPCR/ISH | 6/3 |
| IX | None | Intact | N/A | N/A | N/A | qPCR/ISH | 6/3 | ered formalin for 24-48 hours. Following decalcification (up to 5 days) the samples were embedded in paraffin and sectioned.

In situ hybridization was performed on all groups. QPCR was performed only on groups treated by IN.

Evaluation

CASP2 siRNA delivery into right brain hemisphere, cochlea and spinal cord by ISH: (ErD and IN treated groups and intact controls): was performed with paraffin sections of brain, cochlea and spinal cord, using $^{33}$P-labeled probe.

Brain sagittal sections were prepared medio-laterally from the right hemisphere. The sections were 5 micrometer thick, in intervals of 100 micrometer. The analysis was focused on neuroanatomical afferent and efferent tracts of Vestibulocochlear (VIII) and Trigeminal (V) nerves.

Right Cochlea was prepared for ISH as follows: 5-micrometer thick sections were prepared, in intervals of 50 micrometer. 5 sections from each cochlea that was collected, and subjected to ISH.

siCASP2 ISH in spinal cords was performed on decalcified transverse sections from SC slices representative of several spinal cord segments.

Tissue sections were analyzed by a trained histopathologist.

CASP2 siRNA quantification in brain, plasma, and spinal cord was performed by qPCR (in Intranasal treated groups and intact controls only): RNA was extracted from the entire tissue (with no exception). From the spinal cord segments RNA was extracted with EZ RNA followed by purification on Norgen columns, and from the brain segments by EZ RNA kit only. RNA was transferred for cDNA preparation and siRNA quantification. siRNA quantity in samples was determined by qPCR using SYBR Green method on Applied Biosystem 7300 PCR System. miRNA was used as a reference.

Results

The study showed efficient delivery of siRNA (siCASP2) formulated as eardrop otic pharmaceutical composition to the brain and the spinal cord.

A significant amount of siRNA was detected in the brain, and spinal cord after 6 hours (up to about 20 fmol/μg RNA). In the brain there was significant, above baseline detection of siRNA up to 4 days post administration by eardrops. ISH: The brain from the intact animals showed no hybridization signal. In treated animals siRNA was detected at six hours in the spinal trigeminal tract, principal sensory nucleus, vestibule-cochlear nerve, lateral ventricle ependymal cells and adjacent tissue (hippocampus, striatum and thalamus).

In all 3 brains examined, siRNA hybridization signals were detected. In one of the samples prominent hybridization signals were observed after 1 day of exposure, which were more pronounced than the other 2 samples. In the animals where high intensity hybridization signals were widely detected, signals appeared in lateral ventricle ependymal cells and in the tissue adjacent to them (hippocampus, striatum, thalamus). These signals displayed a gradient pattern. Additional structures showing signals were choroid plexus and meninges. Strong signals with diffused pattern were seen in cerebellum (inferior cerebellar peduncle, middle cerebellar peduncle), spinal trigeminal tract and principal sensory 5 nucleus, spinal 5 nucleus (interpolar part), vestibulocochlear nerve—8n and in facial nerve—7n. A weak signal was observed in dorsal cochlear nucleus. In a second animal, signal was limited to blood vessel endothelium. In a third animal hybridization signal was seen also in pons, possibly in periolivary nuclei in a diffuse pattern.

FIG. 1 shows siCASP2 hybridization signals in brain section, 6 h post ErD application of siRNA. Bright (A) and dark (B) field images demonstrating two adjacent blood vessels, one of which is siRNA positive while the other is not (Original magnification ×20, 12 days exposure).

FIG. 2 shows lateral ventricle and adjacent tissue (Original magnification ×10. Exposure 6 days). When siRNA appeared in ventricles (probably through cerebrospinal fluid CSF), it was also absorbed into the adjacent brain tissue (hippocampus, striatum, thalamus)

Figure 3B:
Figure 3C:
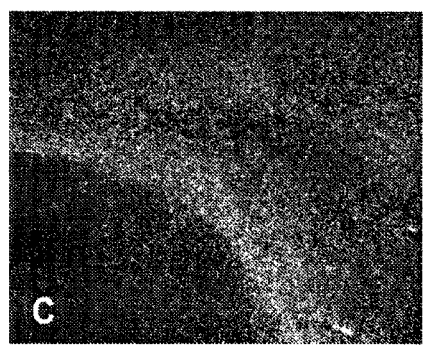

FIG. 3 shows siCASP2 signals in spinal trigeminal tract, principal sensory 5 nucleus, vestibule-cochlear nerve 8n, (Original magnification A ×2.5, B & C ×10, exposure 1d).

FIG. 4 shows CASP2 signal in facial nerve—7n (Original magnification ×10. Exposure 1d).

Example 5

Non-Invasive Otic Delivery of siRNA to the Retina and Brain in Cynomolgus Monkey Assessed by qPCR, In-Situ Hybridization and Fluorescence Microscopy Objective The objective of this study was to evaluate the distribution of siRNA in the eye, ear and brain of female cynomolgus monkeys when administered as eardrops via ear canal once daily for 4 consecutive days. In addition, the toxicokinetic profile of the administered siRNA was also evaluated.

Experimental Design

General:

The study included 3 experimental groups with 2 monkeys each as described in Table 6. Animals from experimental group 3: were treated with Cy3 labeled siRNA compound that targets the mRNA of DDIT4 (DNA-damage-inducible transcript 4) gene.

The chemically modified siRNA compound (DDIT4-Cy3 siRNA) that was used in the preparation of the otic composition utilized in this study is a 19-mer blunt-ended duplex having two separate strands, with an antisense strand (AS, guide strand) comprising 2'OMe sugar modified ribonucleotides at positions 1, 3, 5, 7, 9, 11, 13, 15, 17 and 19 (lower case letters), unmodified modified ribonucleotides at positions 2, 4, 6, 8, 10, 12, 14, 16 and 18 (capital letters) and Cy-3 label covalently attached to the 3' terminus of the antisense strand, and a sense strand (SEN, passenger strand) comprising unmodified ribonucleotides at positions 1, 3, 5, 7, 9, 11, 13, 15, 17 and 19 (capital letters) and 2'OMe sugar modified ribonucleotides at positions 2, 4, 6, 8, 10, 12, 14, 16 and 18 (lower case letters), as depicted:

```
SEN:    5'  GuGcCaAcCuGaUgCaGcU
AS:     5'  aGcUgCaUcAgGuUgGcAc-Cy3  3'
```

TABLE 6

Study Groups

| Group | Treatment | Dose Volume (μL/dose) | Concentration (mg/mL) | No. of Animals Processing Non-perfusion | Perfusion |
|---|---|---|---|---|---|
| 1 | 10% Glycerol | 20 | 25 | 1 | 1 |
| 2 | siCASP2 formulated in 10% Glycerol | 20 | 25 | 2 | 0 |

TABLE 6-continued

Study Groups

| Group | Treatment | Dose Volume (μL/dose) | Concentration (mg/mL) | No. of Animals Processing Non-perfusion | Perfusion |
|---|---|---|---|---|---|
| 3 | Cy3-DDIT4 siRNA formulated in 10% Glycerol | 20 | 25 | 0 | 2 |

Method of Administration

The animals were dosed unilaterally via the external auditory canal with test or control article drop-wise directly on the eardrum (tympanic) membrane while the animal was under ketamine anesthesia and lying on the contra lateral to dosing ear side. Animals remained anesthetized and on their side for 45 minutes. The dosing sides were rotated across both ears between doses. Sequence of dosing for each animal was recorded for each animal.

Dose Frequency:

Animals were dosed once daily for 4 consecutive days. A staggered start was used. The first day of dosing was designated as Study Day (Day) 1 for any given animal.

Dose Volume:

20 μL test/control compound was administrated to each animal on each dosing day.

Pharmacokinetic Sample Analysis and Data Interpretation:

The concentration of siCASP2 and Cy3-DDIT4 siRNA in plasma samples was analyzed using stem-loop qPCR and fluorometric methods, respectively.

Termination

Study animals were food-fasted overnight prior to scheduled sacrifice. On Day 5, PK blood samples were collected from the animals. The respective animals were sedated with ketamine and then euthanized with an overdose of pentobarbital sodium. Perfusion fixation was applied to one animal from Group 1 (vehicle control) and both animals from Group 3 (dosed with Cy3-DDIT4 siRNA). No fixation was applied to another animal from Group 1 (vehicle control) and both animals of Group 2 (dosed with siCASP2). Tissue collection was performed as close as possible to the time of sacrifice. Tissues were preserved as indicated in Table 7.

TABLE 7

Tissue Preservation List

| Tissue | From Perfused Animals | From Non-Perfused Animals | Tissue Weight for Frozen Samples |
|---|---|---|---|
| Animal identification | X | X | — |
| Eyes (L and R) | X | — | — |
| Retina (L and R) | — | X | X |
| Choroids (L and R) | — | X | X |
| Temporal bones (L and R) | X | X | X |
| Optic nerves (Cranial nerve II) (L and R) | X | X | X |
| Vestibulocochlear nerves (Cranial nerve VIII) (L and R) | X | X | X |
| Oculomotor nerves (Cranial nerve III) (L and R) | X | X | X |
| Visual cortex (L and R) | X | X | X |
| Auditory cortex (L and R) | X | X | X |
| Superior colliculi (L and R) | X | X | X |
| Inferior colliculi (L and R) | X | X | X |
| Lateral geniculate nuclei (L and R) | X | X | X |

Post-Mortem Procedures

Gross Necropsy:

All animals were subjected to a selective gross necropsy, which included the tissues collected in this study (as listed in Table 7).

Perfusion Fixation and Tissue Collection for Histopathology:

One animal from Group 1 and both animals from Group 3 were perfused immediately after euthanasia. The hearts of the monkeys were exposed and the right atrium was clipped with surgical scissors. A 16-gauge blunt needle was inserted from the left ventricle into the aorta, and 4% formaldehyde in 0.1M PBS at pH 7.4 (10% neutral buffered formalin) will be administered at 40 mL/min infusion rate for 30 min with an infusion pump.

After perfusion, the selected tissues identified in Table 7 was collected and preserved in 4% formaldehyde in 0.1M PBS at pH 7.4 (10% neutral buffered formalin) (except for the temporal bones) and processed for paraffin embedding.

Eyes:

Whole eyes collected from each animal were processed as follows: each eye was cut midsagittally into two halves. Each eye (in two halves) was preserved in a labeled container with 4% formaldehyde in 0.1M PBS at pH 7.4 (10% neutral buffered formalin).

Temporal Bones:

Temporal bones from both Group 3 animals and one animal from Group 1 were used for 2 types of analysis: (1) analysis of fluorescent siRNA distribution in the inner ear structures performed by confocal microscopy in tissue flat mounts; and (2) analysis of siRNA distribution in the inner ear structures by fluorescent microscopy and in situ hybridization detection in paraffin-embedded tissue section. Each set contained two temporal bones from Group 3 animals (one from the side that was dosed approximately 17 hrs before and another one from the side that was dosed approximately 41 hrs before necropsy) and one temporal bone from control vehicle-dosed animal.

Two temporal bones from Group 3 animals (one from the side that was dosed approximately 17 hrs before and another one from the side that was dosed approximately 41 hrs before necropsy) and one temporal bone from control vehicle-dosed animal (the one dosed approximately 41 hrs before) were placed in a properly labeled container with 4% formaldehyde in 0.1M PBS at pH 7.4 (10% neutral buffered formalin). The tissue was protected at all time from light and left at 5±3° C. until analysis.

Dissection of Temporal Bones for Confocal Microscopy Analysis of Flat Mounts:

Temporal bones conserved in fixative were dissected as follows: with the aid of a binocular dissection microscope, the bony capsule surrounding the cochlea was removed by drilling away the superficial bone and then dissecting away the remaining bone to accesses the soft tissues within inner ear. The spiral ligament was removed and then the basilar membrane was carefully dissected out. In some cases, the spiral ganglion neurons in Rosenthal's canal were also removed. The vestibular sensory epithelium from the saccule, utricle and semicircular canals was carefully dissected out.

When the membranous labyrinth was dissected out, tissue was double stained with Alexa Fluor 488 labeled phalloidin for structural identification of the sensory epithelium in the inner ear, and prepared as a flat surface preparation for observations under confocal microscope.

Dissection of Temporal Bones for In Situ Hybridization Analysis of siRNA Distribution:

Dissection was performed to obtain cochlea and labyrinth bony structure. After dissection, the bony samples were decalcified and paraffin-embedded.

Brain and Cranial Nerve Tissues Trimming and Embedding:

After fixation, the visual cortex was cut vertically paralleling to the central sulcus across the calcarine sulcus and the medial surface was placed down in the cassette. The auditory cortex was cut along the cerebral sulci and the caudal surface was placed down in the cassette. The superior colliculi was cut, as well as the inferior colliculi, and lateral geniculate nuclei through their middle and the anterior parts were placed with the caudal surface down in the cassette. The three cranial nerves were embedded longitudinally. The left and right parts of the brain and cranial nerves were embedded separately.

The tissues listed in Table 7 from the perfused animals were embedded in paraffin. Tissues processing of the eyes was performed manually. All blocks were subjected to slide cutting and test article detection using fluorescent microscopy and in situ hybridization analysis.

Frozen Tissue Samples for Test Article Quantification:

The selected tissues identified in Table 7 were collected from the three non-perfused animals (one animal from Group 1 and both animals from Group 2). The organs identified in Table 7 were dissected, wiped to remove excess liquid, weighed and immediately frozen in liquid nitrogen (at −75±10° C.).

Temporal bones were dissected during necropsy. The following structures were isolated from both ears of each animal: tympanic membrane, lateral walls, cochlea soft tissues, modiolus, inner ear lateral walls, crista and labyrinth soft tissues. All tissues were wiped to remove excess of liquid and positioned into pre-weighed freezing tubes for freezing in liquid nitrogen. Spiral ganglion neurons were obtained from modiolus and frozen.

Results

Both ISH and qPCR analysis demonstrate an above background signal of siRNA delivery to the different regions after ErD administration of otic composition comprising siRNA, as compared to the control group that was administered with application of the vehicle.

Example 6

The Effect of Glycerol Concentration on siRNA Delivery and gene Knock Down Activity in the Rat Retina Using an Ear Drop Formulation, as Determined by qPCR Experimental Design Rats were subjected to unilateral application of otic (eardrop) composition containing 200 µg of siCASP2 in 100 of one of the following vehicles: PBS, 5% glycerol, 10% glycerol, 20% glycerol and 30% glycerol. The concentration of siRNA compound was 10 mg/ml of the otic pharmaceutical composition. The siRNA compound tested was siCASP2, described in Example 1 hereinabove.

Termination

Rats from all groups were euthanized at day 4. The CNS tissues (brain, spinal cord, optic nerve and retina) were dissected and the amount of siRNA in the tissue was determined quantitatively using qPCR. Tissue sections of brain, retinal and spinal cord were prepared.

Results

The study showed the effect of glycerol concentration on the delivery of siRNA, formulated as an otic pharmaceutical composition for eardrop administration, to the Inner Ear and CNS. ISH results indicated slight preference for an otic composition comprising 10% glycerol as a vehicle.

Example 7

Non-Invasive (Ear Drop) Delivery of Otic Pharmaceutical Compositions Comprising siRNA to the Retina in Normal Rats and Assessment of Knock Down Activity by qPCR Objective The study assessed delivery of formulated siRNA to the CNS (brain, retina and spinal cord) after non-invasive administration of otic composition (via eardrops) in normal SD rats.

Test Material:

The test material siCASP2 described in Examples 1, supra, was formulated in 10% glycerol at a concentration of 20 mg/ml in 10% Glycerol solution.

Animals:

Species: Rat; Strain: SD; Source: Harlan, Jerusalem Israel Age: 8-10 weeks; Body Weight Range: 200-250 g; Sex: Males;

Group Size: N=8 qPCR; N=6 ISH; N=4 ISH normal control; Total number of animals: 57.

Animal Husbandry: Diet: Animals were provided an ad libitum commercial rodent diet, and free access to drinking water.

Environment: Following acclimatization of at least 5 days all animals were confined in a limited access facility with environmentally controlled housing conditions throughout the entire study period, and maintained in automatically controlled environmental conditions, set to maintain temperature at 20-24° C. with a relative humidity (RH) of 30-70%, a 12-hr light/12-hr dark cycle and 15-30 air changes/hr in the study room. Temperature, RH and the light cycle were monitored by the control computer throughout the study period.

Experimental Design

General: The study included 9 experimental groups, with 4, 5, 6 or 8 rats in each group as described in Table 8. Animals from experimental groups I-IV and VIII were treated with single application of an otic composition comprising siCASP2 or CNL_1 siRNA in a glycerol based formulation and administered as eardrop/rat/time point: at a dose of 200 mg siRNA in 10 ml of 10% Glycerol composition, delivered by eardrop (ErD) route: REAC (right external auditory canal). CNL_1 siRNA comprises alternating unmodified ribonucleotides and 2'OMe sugar modified ribonucleotides.

```
Sen         5' ACUAAAUUACGCGCGAUGC
Antisense   5' GCAUCGCGCGTAAUUUAGU
```

Animals from experimental Groups V, and VI (vehicle control) were treated REAC with 10 µl of 10% glycerol composition only and experimental groups VII and IX were intact normal control.

TABLE 8

Study Design

| Group No: | siRNA (REAC) | Dose (µg siRNA)/ volume of 10% glycerol | Termination Time Point (hours) | Analysis | Group Size |
|---|---|---|---|---|---|
| I | siCASP2 | 200 µg/10 µl | 6 | qPCR, RACE | 8 |
| II | siCASP2 | 200 µg/10 µl | 24 | qPCR, RACE | 8 |
| III | CNL_1 | 200 µg/10 µl | 6 | qPCR, RACE | 8 |
| IV | CNL_1 | 200 µg/10 µl | 24 | qPCR, RACE | 8 |
| V | None | 10 µl vehicle | 6 | qPCR, RACE | 5 |
| VI | None | 10 µl vehicle | 24 | qPCR, RACE | 5 |
| VII | None (Intact) | None | | qPCR, RACE | 5 |
| VIII | siCASP2 | 200 µg/10 µl | 6 | ISH | 6 |
| IX | None (Intact) | None | | ISH | 4 |

Vehicle: 10% glycerol

Anesthesia:

Rats were anesthetized with 4 ml/kg body weight of Equithesine (I.P.)

Right External Auditory Canal (REAC) Eardrops ErD Delivery:

A 10 µl sample volume (warm (37° C.) 10% glycerol based eardrops) was slowly administered into the external REAC, using a blunt pipette tip. This volume was delivered to the right ear of all rats from groups I-VI, and group VIII, according study design. During and after REAC instillations, rats were kept on the contra lateral side for 1 hour, and returned to their cages after they regained consciousness.

Scheduled Euthanasia:

Rats from groups I-VII were deeply anesthetized (4 ml/kg BW by Equithesine; I.P.) and euthanized according to the study design (Table 9, Time point termination).

Animals from Experimental Groups VIII-IX for ISH Analysis:

Euthanasia was accomplished by transcardial perfusion with 10% neutral buffered formalin for 3-5 minutes with the standard peristaltic pump rate (50 rpm/min).

Tissue Collection:

Eyes for qPCR siRNA detection analysis: Both eyes from all animals of groups I-VII with the optic nerve were enucleated, and stored on ice according to standard procedures. The eyes were dissected using a binocular microscope. The cornea was dissected by a cut along the limbus, lens was gently removed, and the retina and vitreous were carefully separated from the sclera. Whole retinas were collected (Retina including: "neural retina") into appropriate and properly marked test tubes. Dissected retinas were washed in a large volume of PBS (each retina in a separate tube with fresh PBS), extra liquid was removed with Kimwipes and retinas were snap-frozen in liquid nitrogen.

Eyes for ISH analysis: Eyes from all animals of groups VIII-IX were enucleated (following perfusion of the animals) and transferred in 10% NBF for in-situ hybridization of siRNA Whole Brain for qPCR siRNA detection analysis: Brains from all animals of groups I-VII were harvested and snap frozen in liquid nitrogen in properly labeled tubes for extraction of total RNA and further analysis by qPCR.

Whole Brain for ISH analysis: Whole Brain from all animals of groups VIII-IX was harvested and transferred in 10% NBF for in-situ hybridization of siRNA.

Spinal column for qPCR siRNA detection analysis: all animals of groups I-VII were dissected and the thoracic and lumbar part of the spinal cord harvested using the saline extrusion method, snap frozen in liquid nitrogen in properly labeled tubes for extraction of total RNA and further analysis by qPCR.

Spinal column for ISH analysis: harvested from all animals of groups VIII-IX, and transferred to 10% NBF for analysis.

Right and Left temporal bones for qPCR siRNA detection analysis: harvested from all animals of groups I-VII, snap frozen in liquid nitrogen and bony cochleae were dissected and inner ear tissues harvested for extraction of total RNA and further analysis by qPCR.

Right and Left temporal bones for ISH analysis harvested from all animals of groups VIII-IX and transferred in 10% NBF, post fixed for 48 hours and decalcified, embedded in paraffin and sectioned for. siRNA In Situ Hybridization (si-ISH).

Evaluation:

siCASP2 delivery into retinas, brain and spinal cord by qPCR: RNA was extracted from the entire tissue. From the spinal cord RNA was extracted according to standard protocols using EZ RNA followed by purification on Norgen columns, from dissected cochlea samples using Norgen kit according to manufacturer instructions and from the brain and retina samples by EZ RNA kit only cDNA paws prepared from all samples and siRNA quantified.

The quantity of the siCASP2 and the reference CNL_1 siRNA was assessed in RNA samples by qPCR siRNA quantification: cDNA preparation was performed according to Stem-Loop method for Real Time detection of siRNA.

Rapid Amplification of cDNA Ends (RACE) from retinas and cochleas: siCASP2 directed cleavage of CASP2 mRNA in rat retina, cochleas, brain and SC was determined by the detection of the cleavage product using the RACE (Rapid Amplification of cDNA Ends) method in the respective experimental groups.

Histopathology assessment: The siRNA ISH was performed with paraffin sections of Results: At 6 Hours:

siCASP2 treated group showed a significantly (0.0001) lower expression level of CASP2 than vehicle (10% glycerol) treated group (30% lower). CNL_1 treated group showed also a significantly (0.0032) lower expression level of CASP2 than vehicle treated group (24% lower).

At 24 Hours:

siCASP2 treated group showed a significantly (0.0056) lower expression level of CASP2 than of Vehicle treated group (24% lower). CNL_1 treated group showed lower expression level of CASP2 than of Vehicle treated group (8% lower), which was not statistically significant (0.0538). Casp2 knockdown appeared to be bilateral.

siRNA was detected in Retina (siRNA treated groups) at time points 6 and 24 hrs. siRNA was also detected in the Inner Ear of treated groups by qPCR (6 Hrs max).

Table 9 shows CASP2 mean expression quantity in the retina by experimental groups.

TABLE 9

CASP2 mean expression quantity in the retina by experimental groups

| Treat | Hour | N | Mean | Std | Code | Tukey pair-wise p-values | | | | | |
|---|---|---|---|---|---|---|---|---|---|---|---|
| | | | | | | 1 | 2 | 3 | 4 | 5 | 6 |
| CASP2 | 6 | 8 | 0.0382 | 0.0067 | 1 | | 0.7651 | 0.0001 | 0.7493 | 0.0018 | 0.0002 |
| CNL | 6 | 7 | 0.0419 | 0.0032 | 2 | 0.7651 | | 0.0032 | 1.0000 | 0.0694 | 0.0074 |
| VEH | 6 | 5 | 0.0548 | 0.0032 | 3 | 0.0001 | 0.0032 | | 0.0022 | 0.6844 | 1.0000 |
| CASP2 | 24 | 8 | 0.0418 | 0.0058 | 4 | 0.7493 | 1.0000 | 0.0022 | | 0.0538 | 0.0056 |
| CNL | 24 | 7 | 0.0502 | 0.0065 | 5 | 0.0018 | 0.0694 | 0.6844 | 0.0538 | | 0.7638 |
| VEH | 24 | 4 | 0.0547 | 0.0040 | 6 | 0.0002 | 0.0074 | 1.0000 | 0.0056 | 0.7638 | |
| Intact | 0 | 4 | 0.0572 | 0.0089 | | | | | | | |

FIG. 5 shows CASP2 gene knockdown (bar designated as "siGeneX") in the rat retina at 24 hours after administration of otic composition administered via eardrops (Experimental Group II). In this figure CNL_1 group (Experimental Group IV) is identified as "siContr", 10% glycerol group (Experimental Group VI) is identified as "Vehicle" and intact group (Experimental Group VII) is identified as "Intact".

Example 8

Duration of Knockdown (KD) Effect in the Retina siRNA Delivered by Eardrops

Objective

The objective of the study was to determine the activity and knock down (KD) effect of siCASP2 targeting CASP2 in normal rat retina at different time points after single application of otic composition comprising 200 μg siCASP2 in 10 μl 10% Glycerol solution (formulated for eardrop (ErD) administration. The study also assessed the duration of the KD effect in the rat retina when using a single application of otic composition comprising siRNA.

General:

The study design included 13 experimental groups (Table 10). Groups 1-4 and 5-8 were treated with single unilateral (REAC (right external auditory canal)) ErD application of an otic composition comprising siCASP2 or an otic composition comprising EGFP siRNA control test article, at a dose of 200 μg siRNA in 10 μl of 10% Glycerol solution. Groups 9-12 were used as vehicle controls (treated with 10 μl of 10% Glycerol solution). Experimental group 13 was be used as intact normal control. Termination setup and tissues harvesting were accomplished according to the study design (Table 10).

EGFP siRNA control test article (designated siEGFP) that was used in this experiment is a negative control siRNA targeted at the non endogenously expressed GFP gene. It is a 21-mer blunt-ended duplex having two separate strands, with an antisense strand (AS, guide strand) comprising alternating unmodified ribonucleotides (capital letters) and 2'OMe sugar modified ribonucleotides (lower case letters); and a sense strand (SEN, passenger strand) comprising alternating unmodified ribonucleotides (capital letters) and 2'OMe sugar modified ribonucleotides (lower case letters), so that unmodified ribonucleotides of one strand are pair based with 2'OMe sugar modified ribonucleotides in the other strand, as depicted:

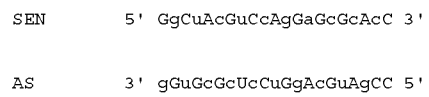

TABLE 10

Study Design

| Group No. | Treatment Mode ErD | Treatment (siRNA Type) | siRNA Dose (μg)/Volume (μl) of 10% Glycerol solution | Time point | Group size |
|---|---|---|---|---|---|
| 1 | Single REAC | siCASP2 | 200 μg/10 μl | 24 hrs | 8 |
| 2 | Single REAC | siCASP2 | 200 μg/10 μl | 48 hrs | 8 |
| 3 | Single REAC | siCASP2 | 200 μg/10 μl | 1 week | 8 |
| 4 | Single REAC | siCASP2 | 200 μg/10 μl | 2 weeks | 8 |
| 5 | Single REAC | siEGFP | 200 μg/10 μl | 24 hrs | 8 |
| 6 | Single REAC | siEGFP | 200 μg/10 μl | 48 hrs | 8 |
| 7 | Single REAC | siEGFP | 200 μg/10 μl | 1 week | 8 |
| 8 | Single REAC | siEGFP | 200 μg/10 μl | 2 weeks | 8 |
| 19 | Single REAC | Vehicle (10% Glycerol solution) | 10 μl | 24 hrs | 8 |
| 10 | Single REAC | Vehicle (10% Glycerol solution) | 10 μl | 48 hrs | 8 |
| 11 | Single REAC | Vehicle (10% Glycerol solution) | 10 μl | 1 week | 8 |
| 12 | Single REAC | Vehicle—(10% Glycerol solution) | 10 μl | 2 weeks | 8 |
| 13 | Intact | N/A | — | 1 day | 4 |
| | | | | 2 days | 4 |
| | | | | 7 days | 8 |
| | | | | 14 days | 8 |

Anesthesia:

Rats (groups 1-15) were deeply anesthetized by Equithesine (Intraperitoneal, I.P; 4 ml/kg) before ErD applications.

Right External Auditory Canal (REAC) Eardrops (ErD)

Delivery:

A 10 μl sample volume (warm (37° C.) 10% glycerol based otic composition (eardrops)) was slowly instilled into the right external auditory canal (REAC), using blunt pipette tip. This volume was delivered according to the study design. During and after REAC instillations, rats were kept on the contra lateral side for about one hour, and were returned to cage after regaining consciousness.

Scheduled Euthanasia:

Rats from all groups will be deeply anesthetized (4 ml/kg BW by Equithesine; I.P.) and euthanized (decapitated) according to the study design (Table 10, Time point termination).

Tissue Collection:

Both eyes from all experimental animals were enucleated. The eyes were dissected, retinas were harvested and collected into separate appropriate test tubes, immediately frozen in liquid nitrogen and transferred for extraction of total RNA and determination of CASP2 gene expression level.

Temporal bones were harvested from all animals, snap frozen in liquid nitrogen and stored at −80° C.

Evaluation

Knockdown activity by siCASP2 in the rat retina was determined by CASP2 mRNA expression level quantification using the qPCR method.

Samples RNA Isolation:

RNA was processed from retina samples utilizing total RNA isolation method with EZ RNA, by double extraction.

CASP2 mRNA Quantification by qPCR:

cDNA was prepared according to known methods of cDNA preparation for Real Time PCR. CASP2 KD was verified by CASP2 mRNA quantification by qPCR. qPCR was performed using SYBR Green method on Applied Biosystem 7300 PCR System.

Results

Results are presented in Table 11. There appeared to be greater reduction in CASP2 levels on day 1 and 2 in the left eye than in the right eye in this set of animals. It can be seen that the differences between CASP2 levels and vehicle decline with time, and turn from significant to insignificant after 2 days mainly since the vehicle expression level declines with time. At 1, 2 and 7 days after eardrop application a significant knock down effect was observed in the contralateral eye to ear drop applications. At two weeks after ear drop applications, the knock down activity was not observed anymore. These results suggest that the knock down activity obtained by non-invasive delivery (by eardrops) of siRNA comprising otic composition can be observed in the retina and maintained up until 1 week after application.

TABLE 11

| | | | Knockdown effect | | | | | | |
|---|---|---|---|---|---|---|---|---|---|
| | Gene | | Left | | | | Right | | |
| Time | Name | N | Mean | S.D. | p.v | N | Mean | S.D. | p.v |
| 1 day | CASP(x1) | 8 | 36.21 | 11.51 | | 8 | 51.37 | 17.3 | |
| | EGFP(x1) | 8 | 52.48 | 5.63 | 0.0473 | 8 | 37.38 | 9.5 | 0.1377 |
| | Intact | 4 | 73.98 | 6.53 | 0.0001 | 4 | 80.78 | 11.23 | 0.0038 |
| | VEH(x1) | 8 | 77.72 | 16.89 | <.0001 | 8 | 50.9 | 9.25 | 0.9998 |
| 2 days | CASP(x1) | 5 | 36.07 | 8.21 | | 6 | 56.95 | 6.98 | |
| | EGFP(x1) | 7 | 63.48 | 6.52 | 0.0018 | 6 | 48.54 | 7.72 | 0.4595 |
| | Intact | 4 | 71.26 | 13.72 | 0.0006 | 4 | 59.62 | 11.55 | 0.9735 |
| | VEH(x1) | 6 | 72.05 | 13.79 | 0.0001 | 7 | 50.77 | 11.97 | 0.6702 |
| 7 days | CASP(x1) | 5 | 35.48 | 2.79 | | 6 | 65.43 | 6.4 | |
| | EGFP(x1) | 4 | 84.36 | 17.28 | <.0001 | 4 | 33.85 | 5.21 | <.0001 |
| | Intact | 8 | 57.67 | 8.07 | 0.0049 | 8 | 52.46 | 6.73 | 0.0133 |
| | VEH(x1) | 5 | 56.43 | 9.77 | 0.0173 | 4 | 53.16 | 9.29 | 0.0585 |
| 14 days | CASP(x1) | 7 | 45.74 | 9.81 | | 7 | 52.94 | 4.41 | |
| | EGFP(x1) | 5 | 90.41 | 21.75 | 0 | 5 | 36.08 | 6.08 | 0.0162 |
| | Intact | 8 | 79.09 | 9.03 | 0.0003 | 8 | 71.11 | 11.45 | 0.0031 |
| | VEH(x1) | 5 | 53.32 | 8.96 | 0.7376 | 5 | 61.04 | 10.09 | 0.4051 |

Example 9

Delivery to the Retina of Non-Invasively Administered siRNA Comprising Otic Composition Formulated for Administration by Eardrops at Different Concentrations of siRNA Objective To assess delivery of siCASP2 in different concentrations to the retina and brain, 6 and 24 hours following a single unilateral application of eardrops (ErD).

Study Design

The study design included 10 experimental groups (Table 11). Otic composition comprising siCASP2 was administered as eardrops (ErD) applied unilaterally via the right external auditory canal (REAC; Groups 1-8). The otic compositions comprised different concentrations of siCASP2 in 10% glycerol solution, as detailed in Table 11 Vehicle (10% glycerol solution) applications were performed using the same application mode (Group 9).

TABLE 12

Study Design

| Group No. | Treatment Mode single unilateral | SiRNA Type | SiRNA Dose/ Volume [μg/10 μl] | Formulation Glycerol | Time point [hrs] | Group size |
|---|---|---|---|---|---|---|
| 1 | ErD REAC | siCASP2 | 50 μg | 10% | 6 | 8 |
| 2 | ErD REAC | siCASP2 | 50 μg | 10% | 24 | 8 |
| 3 | ErD REAC | siCASP2 | 100 μg | 10% | 6 | 8 |
| 4 | ErD REAC | siCASP2 | 100 μg | 10% | 24 | 8 |
| 5 | ErD REAC | siCASP2 | 200 μg | 10% | 6 | 8 |
| 6 | ErD REAC | siCASP2 | 200 μg | 10% | 24 | 8 |
| 7 | ErD REAC | siCASP2 | 400 μg | 10% | 6 | 8 |
| 8 | ErD REAC | siCASP2 | 400 μg | 10% | 24 | 8 |
| 9 | ErD REAC | Vehicle | 10 μl | 10% | 6 | 8 |
| 10 | Intact | N/A | N/A | N/A | N/A | 8 |

Anesthesia:

Rats were anesthetized with 4 ml/kg body weight of Equithesine (Intraperitoneal, I.P.).

Method of Administration:

External auditory canal eardrop application was performed by slowly instilling a 10 μl dose volume (warm (about 37° C.) otic composition) using a blunt pipette tip. During and after ear drop instillations, rats were kept on the contra lateral recumbency for about one hour, and were returned to their cage after regaining consciousness.

Termination:

Rats from all groups were deeply anesthetized (using 4 ml/kg BW by Equithesine; I.P). Animals were sacrificed (decapitated) according to the study design (Table 11, Time point).

Tissue Collection

Systemic blood was collected by cardiac puncture from each animal into EDTA collection tubes. Blood specimens: Collected blood was centrifuged (5 min/5000 rpm, RT); and blood plasma was be separated for further siRNA detection analysis. Extracted total RNA from plasma was used for SiCASP2 quantification by qPCR.

Eyes:

Both eyes from all experimental animals were enucleated, and stored on ice. The eyes were dissected and the retina was dissected and collected into separate appropriate 1.75 ml eppendorf tubes. Wet retinal weights were calculated as follows: The difference between the weight of the empty, labeled test-tube and the weight of the same test-tube containing the dissected retina and data were recorded. Immediately following weighing the tubes were be frozen in liquid nitrogen.

Brain:

Whole Brain was harvested and weighed. Wet Brain weights were recorded, harvested and specimens were snap frozen in liquid nitrogen in properly labeled tubes and subjected to qPCR analysis.

siRNA Quantification

RNA was processed from retina; whole brain and from blood plasma samples for total RNA isolation and cDNA preparation by stem-loop method for Real Time PCR.

siRNA quantity in all samples was determined by qPCR using the SYBR Green method on Applied Biosystem 7300 PCR System. miRNA was used as a reference.

Wet Retina/brain weight—the quantity of siRNA as assessed by qPCR was represented per μg unit of tissue weight and compared to the amount of siRNA observed per μl of plasma.

Example 10

Efficacy of Otic Delivery of siRNA to the Retina in Intraocular Pressure (IOP) Model in Rats—Comparison of Combined Administration by Intravitreal Injection (IVT) and Eardrops to Individual Administration by Eardrops and to Individual Administration by Intravitreal Injection Objective To assess the neuroprotective effect of siCASP2, targeting the Caspase2 gene, as assessed by counting surviving retinal ganglion cells (RGCs) after intraocular pressure (IOP) induction as compared to normal RGC counts and RGC counts in vehicle treated IOP-induced rats, while comparing combined administration by intravitreal (IVT) injection and eardrops, to individual administration by eardrops and to individual administration by IVT injection.

TABLE 13

Study Design

| Group | siRNA Compound | Treatment | IVT | Dose/eye ErD | Administration Time Point | Termination (After IOP induction) | Group size |
|---|---|---|---|---|---|---|---|
| 1 | siCASP2 | Ear Drops | N/A | 300 μg/10 μl 10% glycerol solution | Delivery exp, no IOP | No IOP, termination 24 hours after application | 3 |
| 2 | siDDIT4 | | | 500 μg/10 μl | | | 2 |
| 3 | siCASP2 | Ear Drops | N/A | 200 μg/10 μl 10% glycerol | Twice a week starting at 2 weeks after IOP | 5 weeks | 5 |

TABLE 13-continued

Study Design

| Group | siRNA Compound | Treatment | Dose/eye IVT | Dose/eye ErD | Administration Time Point after IOP | Termination (After IOP induction) | Group size |
|---|---|---|---|---|---|---|---|
| 4 | siEGFP | | | solution | induction (total 6 times during weeks 3, 4, and 5) | | 5 |
| 5 | siCASP2 | IVT + Ear Drops | 20 µg/10 µl PBS | 200 µg/10 µl 10% glycerol solution | IVT Once at 2 weeks after IOP induction, thereafter EarDr twice a week (total 10 times, during week 3 and 4, 5, 6 and 7) | 7 weeks | 5 |
| 6 | siEGFP | | | | | | 5 |
| 7 | SiCASP2 | IVT | 20 µg/10 µl PBS | | Once, at 2 weeks after IOP | 7 weeks | 5/5 |
| 8 | siEGFP | | | | | | |
| 9 | None (Intact) | | | | | — | 5 |

The purpose of this study was to assess the neuroprotective effect of multiple ear drop applications of otic composition comprising siCASP2, an siRNA targeting Caspase2, in a rat model of ocular hypertension (Morrison model) as compared to combined administration by intravitreal (IVT) injection and eardrops and as compared to administration by intravitreal (IVT) injection. In this model, ocular hypertension was induced unilaterally in rats by injecting a hypertonic saline solution (50 µL of 1.85 M NaCl) into an episcleral vein of one eye, which lead to blockage of outflow of aqueous humor resulting in a gradual increase of intraocular pressure (IOP) and progressive loss of RGCs (Morrison et al, 1997). In animals from all study groups, retinal ganglion cells (RGCs) were retrograde labeled by applying the fluorescent tracer DiI (1,1'-dioctadecyl-3,3,3',3'-tetramethylindocarbocyanine) to the superior colliculi. A week later, intraocular hypertension was induced unilaterally. RGC loss at 2 weeks after induction of ocular hypertension was estimated at about 30%. At that time, groups of 6 rats each were either intravitreally (IVT) injected with 20 µg or began receiving weekly ear drop applications of either 200 µg CASP2_4_S510 siRNA/10 µl 10% glycerol solution or 300 µg SiCASP2/10 µl 10% glycerol solution or PBS, or 20 µg of negative control composition comprising siRNA compound siEGFP (targeting GFP gene). Five (in case of groups 9-10) or seven (in case of groups 11-14) weeks later the animals were sacrificed and RGC density was quantified in the retinas of glaucomatous and control eyes. A separate group of naïve rats was used as "Intact" controls (Group 9). In the course of the experiment, IOP was measured in control and treatment groups to ensure equal experimental conditions in experimental and control study groups.

Results

Figure 6:
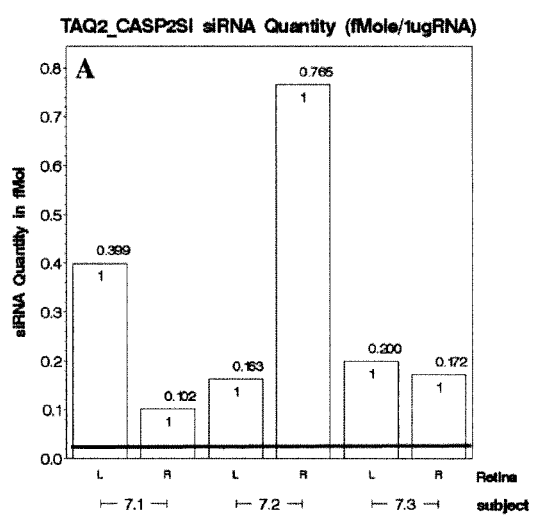
FIG. 6 shows that at 24 hours after ear drop application a low level of siRNA was observed in the retina of each of the three rats. L bars indicate the quantity of siRNA in left eyes and R bars indicate the quantity of siRNA in right eyes of the three mice tested. The black solid line indicates the qPCR background level in non-treated rats.

FIG. 6 shows that at 24 hours after ear drop application a low level of siRNA was observed in the retina of each of the three rats. L bars indicate the siRNA quantity in left eyes and R bars indicate the siRNA in right eyes of the three mice tested. The black solid line indicates the qPCR background level in non-treated rats.

This experiment demonstrates that a siRNA targeting Caspase 2 applied by ear drops affords protection of RGCs from damage induced by increased intraocular pressure that is characteristic of glaucoma.

Example 11

Efficacy of Otic Delivery of siRNA to the Retina in CNV Model in Non-Human Primates CNV Induction Eight male Cynomolgus monkeys (*Macaca fascicularis*) 2-6 years of age are used for the study. Choroidal neovascularization (CNV) is induced by perimacular laser treatment of both eyes prior to dose administration. Nine lesions are placed in the macula with a laser [OcuLight GL (532 nm) Laser Photo-coagulator with an IRIS Medical® Portable Slit Lamp Adaptor], and laser spots in the right eye mirror the placement in the left eye. The approximate laser parameters are as follows: spot size: 50-100 µm diameter; laser power: 300-700 milliwatts; exposure time: 0.1 seconds.

Treatment

Immediately following laser treatment, animals begin receiving weekly ear drop applications of otic pharmaceutical compositions comprising siRNA compounds directed to a target gene or PBS, or a negative control composition comprising siEGFP (targeting GFP gene).

Evaluation

All the animals are subjected to daily examination of food consumption and body weight measurements.

2 monkeys are euthanized at day 6 following CNV induction. Their eyes are enucleated and posterior pole is flattened. Then the fovea region is excised and separated into choroids and neuroretina which are separately (for every animal) frozen in liquid nitrogen to be subsequently used for RNA extraction and real time PCR evaluation of target gene expression.

Fluorescein angiograms are performed pre-study, and at the end of weeks 1, 2, and 3 following CNV induction. Photographs are taken, using a fundus camera (TRC-50EX Retina Camera). Images are captured using the TOPCON IMAGEnet™ system. Fluorescein dye (10% fluorescein sodium, approximately 0.1 mL/kg) is injected via vascular access ports. Photographs are taken at several time points following dye injection, to include the arterial phase, early arteriovenous phase and several late arteriovenous phases in order to evaluate neovascularization and to monitor leakage of fluorescein associated with CNV lesions. Interpretation and analysis of the fluorescein angiograms is independently conducted by two ophthalmologists.

Neovascularization (NV) is assessed in early angiograms and every spot is graded according to the following scheme:
0—no signs of NV
0.5—suspicious spot
1—"hot" spot
2—NV in the laser burn
3—evident NV Leakage is assessed according to the following scheme:
0—no leakage
0.5—suspicious spot
1—evident small spot leakage 2—leakage growing with time
3—leakage greater than previous borders (evidently)

| | |
|---|---|
| Neovascularization (NV) is assessed in early angiograms and every spot is graded according to the following scheme: | |
| 0 | no signs of NV |
| 0.5 | suspicious spot |
| 1 | "hot" spot |
| 2 | NV in the laser burn |
| 3 | evident NV |
| Leakage is assessed according to the following scheme: | |
| 0 | no leakage |
| 0.5 | suspicious spot |
| 1 | evident small spot leakage |
| 2 | leakage growing with time |
| 3 | leakage greater than previous borders (evidently) |

In addition, the size of every spot is compared between the early and the late angiograms using morphometric measurements, and the increase in the spot's size resulting from the leakage is calculated.

Electroretinograms (ERGs) are recorded using an Epic 2000 electroretinograph according to Sierra's SOPs and the study-specific SOP, including the use of the Ganzfield apparatus, at pre-study and in the end of week 3 The tabulated ERG data are evaluated by a veterinary ophthalmologist.

Termination

The study is terminated at day 21 post CNV induction. Gross necropsy and histological examination are performed on organs and tissues including the eyes.

Results

Otic administration of a composition comprising siRNA against target gene reduces target gene expression in the RPE/choroids of laser-treated animals.

Comparison of the spot grading for leakage and neovascularization between the fellow eyes in each individual monkey reveals that both of these pathological characteristics are diminished in the eyes of animals treated with otic composition comprising siRNA directed at a target gene as compared to the control.

Example 12

Efficacy of Otic Administration of siRNA in Model System of Glaucoma and of Retinal Ganglion Cells (RGC) Death in Rats ONC Model in Rats Various animal models are useful for studying the effect of siRNA therapeutics in treating glaucoma. In the optic nerve crush model in rats the orbital optic nerve (ON) of anesthetized rats is exposed through a supraorbital approach, the meninges severed and all axons in the ON transected by crushing with forceps for 10 seconds, 2 mm from the lamina cribrosa. Testing otic pharmaceutical compositions of the invention (comprising at least one siRNA compound directed at a target gene) for treating or preventing glaucoma is performed, for example, in the animal models described by Pease et al. (J. Glaucoma, 2006, 15(6):512-9. Manometric calibration and comparison of TonoLab and TonoPen tonometers in rats with experimental glaucoma and in normal mice).

Optic nerve crush (ONC) model in adult Wistar rats is also an accepted model for studying Retinal Ganglion Cells (RGC) death. The onset and kinetics of RGC death in this model are very reproducible; RGC apoptosis begins on day 4-5 after the ONC; massive RGC loss (about 50-60%) is observed on days 7-10 after the ONC; and 95% of the RGC loss is occurs by week 3-4 after the ONC. This model allows for establishment of the neuroprotective efficacy of test drugs in vivo.

Results

In some non-limiting examples, otic pharmaceutical compositions comprising siRNA compounds directed to target genes are tested in this animal model, which shows that these composition treat and/or prevent glaucoma and/or RGC death when delivered to the ear.

Example 13

Efficacy of Otic Administration of siRNA in Model Systems for Spinal Cord Injury In a non-limiting example, testing of the otic compositions comprising siRNA inhibitors of the present invention for treating spinal cord injury is performed in the rat spinal cord contusion model as described by Young (Prog Brain Res. 2002; 137:231-55). Other predictive animal models of spinal cord injury are described in the following references: Gruner JA. "A monitored contusion model of spinal cord injury in the rat." J. Neurotrauma 1992. 9(2): 123-128; Hasegawa K and Grumet M. "Trauma-induced tumorigenesis of cells implanted into the rat spinal cord." J. Neurosurg. 2003. 98(5): 1065-71; and Huang PP and Young W. "The effects of arterial blood gas values on lesion volumes in a graded rat spinal cord contusion model." J Neurotrauma 1994, 11(5): 547-562.

Otic pharmaceutical compositions of the present invention are tested in these animal models, which show the efficacy of otic compositions comprising siRNA compounds in treating spinal cord injury.

Example 14

Efficacy of Otic Administration of siRNA in Model Systems for CNS Injury in Rats Closed Head Injury (CHI)

Experimental traumatic brain injury (TBI) produces a series of events contributing to neurological and neurometabolic cascades, which are related to the degree and extent of behavioral deficits. CHI is induced under anesthesia, while a weight is allowed to free-fall from a prefixed height (Chen Y et al, J. Neurotrauma. 1996; 13:557-568) over the exposed skull covering the left hemisphere in the midcoronal plane.

Transient Middle Cerebral Artery Occlusion (MCAO)

A 90 to 120 minutes transient focal ischemia is performed in adult, male Sprague Dawley rats, 300-370 gr. The method employed is the intraluminal suture MCAO (Longa E Z et al., Stroke 1989, 20, 84-91, and Dogan A. et al., J. Neurochem. 1999, 72, 765-770). Briefly, under halothane anesthesia, a 3-O-nylon suture material coated with Poly-L-Lysine is inserted into the right internal carotid artery (ICA) through a hole in the external carotid artery. The nylon thread is pushed into the ICA to the right MCA origin (20-23 mm). 90-120 minutes later the thread is pulled off, the animal is closed and allowed to recover.

Permanent Middle Cerebral Artery Occlusion (MCAO)

Occlusion is permanent, unilaterally-induced by electro-coagulation of MCA. Both methods lead to focal brain ischemia of the ipsilateral side of the brain cortex leaving the contralateral side intact (control). The left MCA is exposed via a temporal craniotomy, as described for rats by Tamura A. et al., J Cereb Blood Flow Metab. 1981; 1:53-60. The MCA and its lenticulostriatal branch are occluded proximally to the medial border of the olfactory tract with microbipolar coagulation. The wound is sutured, and animals returned to their home cage in a room warmed at 26° C. to 28° C. The temperature of the animals is maintained all the time with an automatic thermostat.

Evaluation Process

The efficacy of the otic pharmaceutical compositions of the present invention for treating CNS injury is determined by mortality rate, weight gain, infarct volume, short and long term clinical, neurophysiological and behavioral (including feeding behavior) outcomes in surviving animals. Infarct volumes are assessed histologically (Knight R A et al., Stroke. 1994, 25, 1252-1261 and Mintorovitch J. et al., Magn. Reson. Med. 1991. 18, 39-50). The staircase test (Montoya C P et al., J. Neurosci. Methods 1991, 36, 219-228) or the motor disability scale according to Bederson's method (Bederson J B et al., Stroke, 1986, 17, 472-476) is employed to evaluate the functional outcome following MCAO. The animals are followed for different time points, the longest one being two months. At each time point (24 hours, 1 week, 3, 6, 8 weeks), animals are sacrificed and cardiac perfusion with 4% formaldehyde in PBS is performed. Brains are removed and serial coronal 200 μm sections are prepared for processing and paraffin embedding. The sections are stained with suitable dyes such as TCC. The infarct area is measured in these sections using a computerized image analyzer.

Results

Otic pharmaceutical compositions of the present invention are tested in these animal models, which show that these otic pharmaceutical compositions treat CNS injury. The results show that the otic pharmaceutical composition of the invention is efficacious when compared to the controls.

Example 15

Evaluating the Efficacy of Ear Drop Administration of Otic Pharmaceutical Compositions in the APP Transgenic Mouse Model of Alzheimer's Disease The animal models disclosed in the following publications are useful for testing the otic pharmaceutical compositions of the present invention, in particular otic composition comprising at least one siRNA compound that targets the APP, BACE1, ADRB1, CDK5R1, MAPT, CASP3, TGM2, CAMK2A, GABRA1 and SYT1 gene.

Animals and Treatment:

The study includes twenty-four (24) $APP^{V717I}$ transgenic mice (female), a model for Alzheimer's disease (Moechars D. et al., EMBO J. 1996, 15(6):1265-74; and Moechars D. et al., Neuroscience. 1999, 91(3):819-30), aged 11 months that are randomly divided into two equal groups (Group I and Group II).

Animals are treated with ear drop administration of otic pharmaceutical composition comprising at least one siRNA compound directed at a target gene. Animals in control groups are treated with otic administration of a vehicle solution. Compositions comprising the following concentrations of siRNA are tested: (i) 100 μg of siRNA compound/3 μl of vehicle; (ii) 200 μg of siRNA compound/3 μl of vehicle and (iii) 500 μg of siRNA compound/3 μl of vehicle. Compositions comprising the following vehicle are tested: (i) 5% glycerol solution; (ii) 10% glycerol solution and (iii) 15% glycerol solution. In this study the otic compositions are administered once every 4 days, during 3-4 month period of the experiment, in the form of eardrops, by slow instillation into the external REAC, using a blunt pipette tip.

Termination

Mice are sacrificed; brains are dissected and processed as follows: one hemisphere for histological analysis and one hemisphere for molecular biology analysis.

Evaluation Process

The following histological analysis is performed:
1. Anti-amyloid β (Aβ) staining and quantification (4 slides/mouse)
2. Thioflavin S staining and quantification of Aβ plaques (4 slides/mouse)
3. CD45 staining and quantification (4 slides/mouse)
4. GFAP (astrocytosis) staining and quantification Results Otic pharmaceutical compositions of the present invention are tested in this animal model, which shows that topical otic formulations comprising the siRNA compounds are useful in treating Alzheimer's disease.

Example 16

Evaluating the Efficacy of Ear Drop Administration of Otic Pharmaceutical Compositions Comprising siRNA Compounds in a BACE1-Transgenic Mouse Model of Alzheimer's Disease The animal model disclosed hereinbelow is useful for testing the otic compositions of the present invention, in particular otic compositions comprising at least one siRNA compound that targets the APP, BACE1, ADRB1, CDK5R1, MAPT, CASP3, TGM2, CAMK2A, GABRA1 and SYT1 gene.

Objective

The objective of this study is to test the efficacy of ear drop delivery of an otic pharmaceutical composition comprising at least one siRNA compound directed at a target gene in BACE1-transgenic mouse model for Alzheimer's disease.

Animals and Treatment

The study includes twenty (20) BACE1 transgenic mice (female/male), aged 4 months that are randomly divided into two equal groups. Treatment is initiated at age 4 months.

Animals are treated with ear drop administration of otic pharmaceutical composition comprising at least one siRNA compound directed at a target gene. Animals in control groups are treated with otic administration of a vehicle solution. Compositions comprising the following concentrations of siRNA are tested: (i) 100 µg of siRNA compound/3 µl of vehicle; (ii) 200 µg of siRNA compound/3 µl of vehicle and (iii) 500 µg of siRNA compound/3 µl of vehicle. Compositions comprising the following vehicle are tested: (i) 5% glycerol solution; (ii) 10% glycerol solution and (iii) 15% glycerol solution. In this study the otic compositions are administered once every 4 days, during 3-4 month period of the experiment, in the form of eardrops, by slow instillation into the external REAC, using a blunt pipette tip.

Evaluation Process

1. Behavioral test. All animals are monitored and tested for behavioral changes by subjecting the animals to periodical behavioral analysis. Spatial learning and memory in the Morris water maze is used.
2. Brain biochemistry. The brains of five (5) mice in each group are subjected to biochemical analysis. Western blot analysis of BACE, APP, CTFs and Aβ is carried out. Assay for BACE enzymatic activity is performed.
3. Immunohistochemistry. The left hemibrain of five (5) mice in each group is subjected to immunohistochemical analysis. Expression levels of BACE, APP and CTF are determined.
4. Analysis of gene knockdown by qPCR are performed in the right hemibrain of five (5) mice in each group.

Results

Otic pharmaceutical compositions of the present invention are tested in this animal model, which shows that topical otic formulations comprising siRNA compounds are useful in treating Alzheimer's disease.

Example 17

Evaluating the Efficacy of Ear Drop Administration of an Otic Pharmaceutical Composition Comprising siRNA in a Mouse Model of ALS The animal model disclosed hereinbelow is useful for testing the otic pharmaceutical compositions of the present invention, in particular otic compositions comprising at least one siRNA compound that targets the CDK5R1, CBLN1, FUS, TARDP, SOD1 and NFE2L3 gene.

Objective

To examine the efficacy of otic pharmaceutical composition comprising at least one siRNA compound directed at a target gene associated with ALS in the mutant SOD1$^{G93A}$ mouse model of ALS.

Animals and Treatment

The following experimental groups are used for studying disease progression and lifespan:

Group 1 (Test)—is administered with an otic composition comprising a at least one siRNA compound directed at a target gene associated with ALS. This group comprises wild-type (n=10) and SOD1$^{G93A}$ (n=10) mice.

Group 2—(Control siRNA): is administered with an otic composition comprising a control siRNA compound (such as EGFP siRNA). This group comprises wild-type (n=10) and SOD1$^{G93A}$ (n=10) mice.

Group 3 (Vehicle): is administered with a vehicle solution (such as 10% glycerol solution). This group comprises wild-type (n=10) and SOD1$^{G93A}$ (n=10) mice.

Group 4 (Untreated controls)—This group comprises wild-type (n=10) and SOD1$^{G93A}$ (n=10) mice.

Each experimental group is sex matched (5 male, 5 female) and contain littermates from at least 3 different litters. This design reduces bias that may be introduced by using mice from only a small number of litters, or groups of mice with a larger percentage of female SOD1$^{G93A}$ mice (since these mice live 3-4 days longer than males).

Administration of Otic Pharmaceutical Compositions:

Animals in test group are treated with ear drop administration of otic pharmaceutical composition comprising at least one siRNA compound directed at a target gene. Animals in control siRNA group are treated with otic administration of an otic composition comprising a control siRNA compound (such as EGFP siRNA). Animals in vehicle group are treated with otic administration of a vehicle solution. Compositions comprising the following concentrations of siRNA are tested: (i) 100 µg of siRNA compound/3 µl of vehicle; (ii) 200 µg of siRNA compound/3 µl of vehicle and (iii) 500 µg of siRNA compound/3 µl of vehicle. Compositions comprising the following vehicle are tested: (i) 5% glycerol solution; (ii) 10% glycerol solution and (iii) 15% glycerol solution. In this study the otic compositions are administered once every 4 days, starting from 30 days of age, in the form of eardrops, by slow instillation into the external REAC, using a blunt pipette tip.

Analysis of Disease Progression:

Behavioral and electromyography (EMG) analysis in treated and untreated mice is performed to monitor disease onset and progression. Mice are pre-tested before start of treatment, followed by weekly assessments. All results are compared statistically. The following tests are performed:

1. Swimming tank test: this test is particularly sensitive at detecting changes in hind-limb motor function (Raoul C et al., Nature Med. 2005. 11, 423-428; Towne C et al, Mol Ther. 2008, 16:1018-1025).
2. Electromyography: EMG assessments are performed in the gastrocnemius muscle of the hind limbs, where compound muscle action potential (CMAP) is recorded (Raoul C et al., 2005. supra).
3. Body weight: The body weight of mice is recorded weekly, as there is a significant reduction in the body weight of SOD1$^{G93A}$ mice during disease progression (Kieran D et al., PNAS, 2007, 104(51): 20606-20611).

Assessment of Lifespan

The lifespan in days for treated and untreated mice is recorded and compared statistically to determine whether treatment by administering an otic pharmaceutical composition comprising siRNA directed at a target gene implicated in ALS has any significant effect on lifespan. Mice are sacrificed at a well-defined disease end point, when they have lost >20% of body weight and are unable to raise themselves in under 20 seconds. All results are compared statistically.

Post Mortem Histopathology

At the disease end-point mice are terminally anaesthetized and spinal cord and hind-limb muscle tissue are collected for histological and biochemical analysis.

Examining Motor Neuron Survival

Transverse sections of lumbar spinal cord are cut using a cryostat and stained with gallocyanin, a nissl stain. From these sections the number of motor neurons in the lumbar spinal cord is counted (Kieran et al., 2007. supra), to determine whether siRNA treatment prevents motor neuron degeneration in SOD1$^{G93A}$ mice.

Examining Spinal Cord Histopathology

Motor neuron degeneration in SOD1$^{G93A}$ mice results in astrogliosis and activation of microglial cells. Here, using transverse sections of lumbar spinal cord the activation of astrocytes and microglial cells is examined using immunocytochemistry to determine whether siRNA treatment reduced or prevented their activation.

Examining Muscle Histology.

Hind-limb muscle denervation and atrophy occur as a consequence of motor neuron degeneration in SOD1$^{G93A}$ mice.

At the disease end point the weight of individual hind-limb muscles (gastrocnemius, soleus, tibialis anterior, extensor digitorium longus muscles) is recorded and compared between treated and untreated mice. Muscles are then processed histologically to examine motor end plate denervation and muscle atrophy (Kieran et al., 2005. *J Cell Biol.* 169, 561-567).

Example 18

Efficacy of Otic Delivery of siRNA in a Chronic Mild Stress (CMS) Model in Rats

The animal model disclosed hereinbelow is useful for testing the methods and compositions of the present invention, in particular an otic pharmaceutical composition comprising siRNA that target the SYT1 and NRGN genes.
Animals
Male Wistar rats are singly housed with food and water freely available, and maintained on a 12-h light/dark cycle (lights on at 08.00 am) in a constant temperature ($22\pm°$ C.) and humidity ($55\pm5\%$).
Procedure
The animals are first trained to consume a 1% sucrose solution; training consists of several 1-hr baseline tests (twice weekly) in which sucrose solution is presented, in the home cage, following 14 hr food and water deprivation. Subsequently, sucrose consumption is monitored, under similar conditions, throughout the duration of the study. On the basis of their sucrose intakes in the final baseline test (Day 0), the animals are divided into two matched groups. One group of animals is subjected to the CMS procedure for a period of 8 consecutive weeks. Each week of the stress regime consists of: two periods of food or water deprivation, two periods of 45-degree cage tilt, two periods of intermittent illumination (light on and off every 2 h), two periods of soiled cage (250 ml water in sawdust bedding), two periods of paired housing, two periods of low intensity stroboscopic illumination (150 flashes/min), and two periods of no stress. All the stressors are of 10-14 hr duration and are applied individually and continuously, day and night. Control non-stressed animals are housed in separate rooms and have no contact with the stressed animals. They are deprived of food and water for 14 hr before each sucrose test, but otherwise food and water are available at libitum.

On the basis of their sucrose intake scores following initial 3 weeks of stress, both stressed and control animals are further divided into matched subgroups, and for the subsequent five weeks they receive daily intraperitoneal injections of vehicle (distilled water, 1 ml/kg), imipramine (10 mg/kg), citalopram (10 mg/kg), moclobemide (10 mg/kg) or amphetamine as drug controls. The test animals receive one of the otic pharmaceutical compositions of the invention. The drugs are administered at 10.00 and the weekly sucrose tests are carried out 24 hr following the last drug injection.

At various time points of the CMS procedure (see below), the control and stressed animals are decapitated, five brain structures (frontal cortex, hippocampus, Amygdala, nucleus accumbens, hypothalamus, pons) are dissected, frozen and transferred for further molecular analysis.

The structures are isolated from the following groups:
4 groups of control animals (decapitated on days 22, 29, 36 and 64 of the CMS procedure)
4 groups of stressed animals (decapitated on days 22, 29, 36 and 64 of the CMS procedure)
3 groups of stressed animals receiving imipramine, citalopram, moclobemide, amphetamine or otic compositions comprising siRNA inhibitor of the invention (decapitated on day 29, 36, and 64 of the CMS procedure). The group of rats euthanized on day 64 includes both, animals responding and non-responding to antidepressant treatments.
Results
The animals receiving the otic pharmaceutical composition of the invention display less stress than the control animals (receiving water or receiving known drugs).

Example 19

Efficacy of Otic Delivery of siRNA in a Model Systems of Huntington's Disease (HD) in Mice The animal model disclosed hereinbelow is useful for testing the methods and compositions of the present invention, in particular otic pharmaceutical compositions comprising siRNA that target the TGM2 and ADRB1 genes.

In a non-limiting example, testing of the compositions of the present invention for treating Huntington's disease is performed in the HD mouse model, R6/2 as described by Yu-Lai Wang et al. (Clinico-pathological rescue of a model mouse of Huntington's disease by siRNA. Neurosci Res 53(3):241-9). The otic pharmaceutical compositions tested in this animal model using (i) transtympanic injections or (ii) liquid ear drops for non-invasive delivery.
Results
The compositions and methods of the present invention are tested in this animal model, which shows efficacy of otic pharmaceutical compositions comprising siRNA that target the TGM2 and ADRB1 genes in treating Huntington's disease.

The invention has been described broadly and generically herein. Each of the narrower species and subgeneric groupings falling within the generic disclosure also form part of the invention. This includes the generic description of the invention with a proviso or negative limitation removing any subject matter from the genus, regardless of whether or not the removed material is specifically recited herein. Other embodiments are within the following claims.

---

SEQUENCE LISTING (293 sequences)

SEQ ID NO: 1 - RNA, 3648 nt, Homo_Sapiens
ggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggagguacccacugaugguaaugcuggccugcuggcugaaccccagauugccauguucuguggcagacugaacaugcacaugaauguccagaaugggaagugggauucagauccaucagggaccaaaaccugcauugauaccaaggaaggcauccugcaguauugccaagaagucuacccugaacugcagaucaccaaugugguagaagccaaccaaccagugaccauccagaacuggugcaagcggggccgcaagcagugcaagacccauccccacuuugugauucccuaccgcugcuuaguuggugaguuuguaagugaugcccuucucguuccugacaagugcaaauucuuacaccaggagaggauggauguuugcgaaacucaucuucacuggcacaccgucgccaaagagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgagaggugugcucugaacaagccgagacggggccgugccgagcaaugaucucccgcugguacuuugaugugacugaagggaagugugccccauucuuuuacggcggauguggcggcaaccggaacaacuuugacacagaagaguacugcauggccguguguggcagcgccaugucccaaaguuuacucaagacuacccaggaaccucuugcccgagauccuguuaaacuuccuacaacagcagccaguaccccugaugccguugacaaguaucucgagacaccuggggaugagaaugaacaugcccauuuccagaaagccaaagagaggcuugaggccaagcaccgagagagaaugucccaggucaugagagaaugggaagaggcagaacgucaagcaaagaacuugccuaaagcugauaagaaggcaguuauccagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggccucgucacguguucaauaugcuaaagaaguauguccgcgcagaacagaaggacagacagcacacccuaaagcauuucgagcaugugcgcaugguggaucccaagaaagccgcucagauccggucccagguuaugacacaccuccgugugauuuaugagcgcaugaaucagucucucucccugcucuacaacgugccugcaguggccgaggagauucaggaugaaguugaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaaguugagccuguugaugcccgcccugcugccgaccgaggacugaccacucgaccagguucuggguugacaaauaucaagacggaggagaucucugaagugaagauggaugcagaauuccgacaugacucaggauaugaaguucaucaucaaaaauugguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagcaaaaaaaaaaaaaaaa

SEQ ID NO: 2 - RNA, 3591 nt, Homo_Sapiens
ggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggagguacccacugaugguaaugcuggccugcuggcugaaccccagauugccauguucuguggcagacugaacaugcacaugaauguccagaaugggaagugggauucagauccaucagggaccaaaaccugcauugauaccaaggaaggcauccugcaguauugccaagaagucuacccugaacugcagaucaccaaugugguagaagccaaccaaccagugaccauccagaacuggugcaagcggggccgcaagcagugcaagacccauccccacuuugugauucccuaccgcugcuuaguuggugaguuuguaagugaugcccuucucguuccugacaagugcaaauucuuacaccaggagaggauggauguuugcgaaacucaucuucacuggcacaccgucgccaaagagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgagaggugugcucugaacaagccgagacggggccgugccgagcaaugaucucccgcugguacuuugaugugacugaagggaagugugccccauucuuuuacggcggauguggcggcaaccggaacaacuuugacacagaagaguacugcauggccguguguggcagcgccauuccuacaacagcagccaguaccccugaugccguugacaaguaucucgagacaccuggggaugagaaugaacaugcccauuuccagaaagccaaagagaggcuugaggccaagcaccgagagagaaugucccaggucaugagagaaugggaagaggcagaacgucaagcaaagaacuugccuaaagcugauaagaaggcaguuauccagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggccucgucacguguucaauaugcuaaagaaguauguccgcgcagaacagaaggacagacagcacacccuaaagcauuucgagcaugugcgcaugguggaucccaagaaagccgcucagauccggucccagguuaugacacaccuccgugugauuuaugagcgcaugaaucagucucucucccugcucuacaacgugccugcaguggccgaggagauucaggaugaaguugaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaaguugagccuguugaugcccgcccugcugccgaccgaggacugaccacucgaccagguucuggguugacaaauaucaagacggaggagaucucugaagugaagauggaugcagaauuccgacaugacucaggauaugaaguucaucaucaaaaauugguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagcaaaaaaaaaaaaaaaa

SEQ ID NO: 3 - RNA, 3423 nt, Homo_Sapiens
ggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggagguacccacugaugguaaugcuggccugcuggcugaaccccagauugccauguucuguggcagacugaacaugcacaugaauguccagaaugggaagugggauucagauccaucagggaccaaaaccugcauugauaccaaggaaggcauccugcaguauugccaagaagucuacccugaacugcagaucaccaaugugguagaagccaaccaaccagugaccauccagaacuggugcaagcggggccgcaagcagugcaagacccauccccacuuugugauucccuaccgcugcuuaguuggugaguuuguaagugaugcccuucucguuccugacaagugcaaauucuuacaccaggagaggauggauguuugcgaaacucaucuucacuggcacaccgucgccaaagagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgaguuccuacaacagcagccaguaccccugaugccguugacaaguaucucgagacaccuggggaugagaaugaacaugcccauuuccagaaagccaaagagaggcuugaggccaagcaccgagagagaaugucccaggucaugagagaaugggaagaggcagaacgucaagcaaagaacuugccuaaagcugauaagaaggcaguuauccagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggccucgucacguguucaauaugcuaaagaaguauguccgcgcagaacagaaggacagacagcacacccuaaagcauuucgagcaugugcgcaugguggaucccaagaaagccgcucagauccggucccagguuaugacacaccuccgugugauuuaugagcgcaugaaucagucucucucccugcucuacaacgugccugcaguggccgaggagauucaggaugaaguugaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaaguugagccuguugaugcccgcccugcugccgaccgaggacugaccacucgaccagguucuggguugacaaauaucaagacggaggagaucucugaagugaagauggaugcagaauuccgacaugacucaggauaugaaguucaucaucaaaaauugguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagcaaaaaaaaaaaaaaaa

SEQ ID NO: 4 - RNA, 3255 nt, Homo_Sapiens
ggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggaggucuacccugaacugcagaucaccaaugugguagaagccaaccaaccagugaccauccagaacuggugcaagcggggccgcaagcagugcaagacccauccccacuuugugauucccuaccgcugcuuaguuggugaguuuguaagugaugcccuucucguuccugacaagugcaaauucuuacaccaggagaggauggauguuugcgaaacucaucuucacuggcacaccgucgccaaagagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgaguuccuacaacagcagccaguaccccugaugccguugacaaguaucucgagacaccuggggaugagaaugaacaugcccauuuccagaaagccaaagagaggcuugaggccaagcaccgagagagaaugucccaggucaugagagaaugggaagaggcagaacgucaagcaaagaacuugccuaaagcugauaagaaggcaguuauccagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggccucgucacguguucaauaugcuaaagaaguauguccgcgcagaacagaaggacagacagcacacccuaaagcauuucgagcaugugcgcaugguggaucccaagaaagccgcucagauccggucccagguuaugacacaccuccgugugauuuaugagcgcaugaaucagucucucucccugcucuacaacgugccugcaguggccgaggagauucaggaugaaguugaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaaguugagccuguugaugcccgcccugcugccgaccgaggacugaccacucgaccagguucuggguugacaaauaucaagacggaggagaucucugaagugaagauggaugcagaauuccgacaugacucaggauaugaaguucaucaucaaaaauugguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagcaaaaaaaaaaaaaaaa

SEQ ID NO: 5 - RNA, 3480 nt, Homo_Sapiens
ggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggaggucuacccugaacugcagaucaccaaugugguagaagccaaccaaccagugaccauccagaacuggugcaagcggggccgcaagcagugcaagacccauccccacuuugugauucccuaccgcugcuuaguuggugaguuuguaagugaugcccuucucguuccugacaagugcaaauucuuacaccaggagaggauggauguuugcgaaacucaucuucacuggcacaccgucgccaaagagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgagaggugugcucugaacaagccgagacggggccgugccgagcaaugaucucccgcugguacuuugaugugacugaagggaagugugccccauucuuuuacggcggauguggcggcaaccggaacaacuuugacacagaagaguacugcauggccguguguggcagcgccaugucccaaaguuuacucaagacuacccaggaaccucuugcccgagauccuguuaaacuuccuacaacagcagccaguaccccugaugccguugacaaguaucucgagacaccuggggaugagaaugaacaugcccauuuccagaaagccaaagagaggcuugaggccaagcaccgagagagaaugucccaggucaugagagaaugggaagaggcagaacgucaagcaaagaacuugccuaaagcugauaagaaggcaguuauccagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggccucgucacguguucaauaugcuaaagaaguauguccgcgcagaacagaaggacagacagcacacccuaaagcauuucgagcaugugcgcaugguggaucccaagaaagccgcucagauccggucccagguuaugacacaccuccgugugauuuaugagcgcaugaaucagucucucucccugcucuacaacgugccugcaguggccgaggagauucaggaugaaguugaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaaguugagccuguugaugcccgcccugcugccgaccgaggacugaccacucgaccagguucuggguugacaaauaucaagacggaggagaucucugaagugaagauggaugcagaauuccgacaugacucaggauaugaaguucaucaucaaaaauugguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagcaaaaaaaaaaaaaaaa

SEQ ID NO: 6 - RNA, 6762 nt, Homo_Sapiens
ggacggccgagcggcagggcgcucgcgcgcgcccacuaguggccggaggagaaggcucccgcggaggccgcgcugcccgcccccuccccuggggaggcucgcguucccgcugcucgcgccugcgccgcccgccggccucaggaacgcgcccucuucgccggcgcgcgcccucgcagucaccgccacccaccagcuccggcaccaacagcagcgccgcugccaccgcccaccuucugccgccgccaccacagccaccuucuccuccuccgcuguccucucccguccucgccucugucgacuaucaggugaacuuugaaccaggauggcugagccccgccaggaguucgaagugauggaagaucacgcugggacguacggguugggggacaggaaagaucaggggggcuacaccaugcaccaagaccaagagggugacacggacgcuggccugaaagaaucuccccugcagacccccacugaggacggaucugaggaaccgggcucugaaaccucugaugcuaagagcacuccaacagcggaagaugugacagcacccuuaguggaugagggagcucccggcaagcaggcugccgcgcagccccacacggagaucccagaaggaaccacagcugaagaagcaggcauuggagacacccccagccuggaagacgaagcugcuggucacgugacccaagagccugaaagugguaaggugguccaggaaggcuuccuccgagagccaggccccccaggucugagccaccagcucauguccggcaugccuggggcuccccuccugccugagggccccagagaggccacacgccaaccuucggggacaggaccugaggacacagagggcggccgccacgccccugagcugcucaagcaccagcuucuaggagaccugcaccaggaggggccgccgcugaagggggcagggggcaaagagaggccggggagcaaggaggagguggaugaagaccgcgacgucgaugaguccuccccccaagacuccccucccuccaaggccuccccagcccaagaugggcggccuccccagacagccgccagagaagccaccagcaucccaggcuucccagcggagggugccaucccccucccuguggauuuccucuccaaaguuuccacagagaucccagccucagagcccgacgggcccaguguagggcgggccaaagggcaggaugccccccuggaguucacguuucacguggaaaucacacccaacgugcagaaggagcaggcgcacucggaggagcauuugggaagggcugcauuuccaggggccccuggagaggggccagaggcccggggccccucuuugggagaggacacaaaagaggcugaccuuccagagcccucugaaaagcagccugcugcugcuccgcgggggaagcccgucagccgggucccucaacucaaagcucgcauggucaguaaaagcaaagacgggacuggaagcgaugacaaaaaagccaagacauccacacguuccucugcuaaaaccuugaaaaauaggccuugccuuagccccaaacaccccacuccugguagcucagacccucugauccaacccuccagcccugcugugugcccagagccaccuuccucuccuaaauacgucucuucugucacuucccgaacuggcaguucuggagcaaaggagaugaaacucaagggggcugaugguaaaacgaagaucgccacaccgcggggagcagccccuccaggccagaagggccaggccaacgccaccaggauuccagcaaaaaccccgcccgcuccaaagacaccacccagcucuggugaaccuccaaaaucaggggaucgcagcggcuacagcagccccggcuccccaggcacucccggcagccgcucccgcaccccgucccuuccaaccccacccacccgggagcccaagaagguggcagugguccguacuccacccaagucgccgucuuccgccaagagccgccugcagacagcccccgugcccaugccagaccugaagaaugucaaguccaagaucggcuccacugagaaccugaagcaccagccgggaggcgggaaggugcagauaauuaauaagaagcuggaucuuagcaacguccaguccaaguguggcucaaaggauaauaucaaacacgucccgggaggcggcagugugcaaauagucuacaaaccaguugaccugagcaaggugaccuccaaguguggcucauuaggcaacauccaucauaaaccaggagguggccagguggaaguaaaaucugagaagcuugacuucaaggacagaguccagucgaagauugggucccuggacaauaucacccacgucccuggcggaggaaauaaaaagauugaaacccacaagcugaccuuccgcgagaacgccaaagccaagacagaccacggggcggagaucguguacaagucgccaguggugucuggggacacgucuccacggcaucucagcaaugucuccuccaccggcagcaucgacaugguagacucgccccagcucgccacgcuagcugacgaggugucugccucccuggccaagcaggguuugugaucaggccccuggggcggucaauaauuguggagaggagagaaugagagaguguggaaaaaaaaagaauaaugacccggcccccgcccucugcccccagcugcuccucgcaguucgguuaauugguuaaucacuuaaccugcuuuugucacucggcuuuggcucgggacuucaaaaucagugaugggaguaagagcaaauuucaucuuuccaaauugaugggugggcuaguaauaaaauauuuaaaaaaaaacauucaaaaacauggccacauccaacauuuccucaggcaauuccuuuugauucuuuuuucuucccccuccauguagaagagggagaaggagaggcucugaaagcugcuucugggggauuucaagggacugggggugccaaccaccucuggcccuguugugggggugucacagaggcaguggcagcaacaaaggauuugaaacuugguguguucguggagccacaggcagacgaugucaaccuugugugagugugacggggguugggguggggcgggaggccacgggggaggccgaggcaggggcugggcagaggggagaggaagcacaagaagugggagugggagaggaagccacgugcuggagaguagacaucccccuccuugccgcugggagagccaaggccuaugccaccugcagcgucugagcggccgccuguccuugguggccgggggugggggccugcugugggucagugugccacccucugcagggcagccugugggagaagggacagcggguaaaaagagaaggcaagcuggcaggaggguggcacuucguggaugaccuccuuagaaaagacugaccuugaugucuugagagcgcuggccucuuccucccucccugcaggguagggggccugaguugaggggcuucccucugcuccacagaaacccuguuuuauugaguucugaagguuggaacugcugccaugauuuuggccacuuugcagaccugggacuuuagggcuaaccaguucucuuuguaaggacuugugccucuugggagacguccacccguuuccaagccugggccacuggcaucucuggagugugugggggucugggaggcaggucccgagcccccuguccuucccacggccacugcagucaccccgucugcgccgcugugcuguugucugccgugagagcccaaucacugccuauaccccucaucacacgucacaaugucccgaauucccagccucaccaccccuucucaguaaugacccugguugguugcaggagguaccuacuccauacugagggugaaauuaagggaaggcaaaguccaggcacaagagugggaccccagccucucacucucaguuccacucauccaacugggacccucaccacgaaucucaugaucugauucgguucccugucuccuccucccgucacagaugugagccagggcacugcucagcugugacccuagguguuucugccuuguugacauggagagagcccuuuccccugagaaggccuggccccuuccugugcugagcccacagcagcaggcugggugucuugguugucagugguggcaccaggauggaagggcaaggcacccagggcaggcccacagucccgcugucccccacuugcacccuagcuuguagcugccaaccucccagacagcccagcccgcugcucagcuccacaugcauaguaucagcccuccacacccgacaaaggggaacacacccccuuggaaaugguucuuuucccccagucccagcuggaagccaugcugucuguucugcuggagcagcugaacauauacauagauguugcccugcccuccccaucugcacccuguugaguuguaguuggauuugucuguuuaugcuuggauucaccagagugacuaugauagugaaaagaaaaaaaaaaaaaaaaaaggacgcauguaucuugaaaugcuuguaaagagguuucuaacccacccucacgaggugucucucacccccacacugggacucguguggccuguguggugccacccugcuggggccucccaaguuuugaaaggcuuuccucagcaccugggacccaacagagaccagcuucuagcagcuaaggaggccguucagcugugacgaaggccugaagcacaggauuaggacugaagcgaugauguccccuucccuacuuccccuuggggcucccugugucagggcacagacuaggucuuguggcuggucuggcuugcggcgcgaggaugguucucucuggucauagcccgaagucucauggcagucccaaaggaggcuuacaacuccugcaucacaagaaaaaggaagccacugccagcuggggggaucugcagcucccagaagcuccgugagccucagccaccccucagacuggguuccucuccaagcucgcccucuggaggggcagcgcagccucccaccaagggcccugcgaccacagcagggauugggaugaauugccuguccuggaucugcucuagaggcccaagcugccugccugaggaaggaugacuugacaagucaggagacacuguucccaaagccuugaccagagcaccucagcccgcugaccuugcacaaacuccaucugcugccaugagaaaagggaagccgccuuugcaaaacauugcugccuaaagaaacucagcagccucaggcccaauucugccacuucugguuuggguacaguuaaaggcaacccugagggacuuggcaguagaaauccagggccuccccuggggcuggcagcuucgugugcagcuagagcuuuaccugaaaggaagucucugggcccagaacucuccaccaagagccucccugccguucgcugagucccagcaauucuccuaaguugaagggaucugagaaggagaaggaaaugugggguagauuugguggugguuagagauaugccccccucauuacugccaacaguuucggcugcauuucuucacgcaccucgguuccucuuccugaaguucuugugcccugcucuucagcaccaugggccuucuuauacggaaggcucugggaucucccccuuguggggcaggcucuuggggccagccuaagaucaugguuuagggugaucagugcuggcagauaaauugaaaaggcacgcuggcuugugaucuuaaaugaggacaauccccccagggcugggcacuccuccccuccccucacuucucccaccugcagagccaguguccuugggugggcuagauaggauauacuguaugccggcuccuucaagcugcugacucacuuuaucaauaguuccauuuaaauugacuucaguggugagacuguauccuguuugcuauugcuuguugugcuauggggggaggggggaggaauguguaagauaguuaacaugggcaaagggagaucuuggggugcagcacuuaaacugccucguaacccuuuucaugauuucaaccacauuugcuagagggagggagcagccacggaguuagaggcccuugggguuucucuuuuccacugacaggcuuucccaggcagcuggcuaguucauucccuccccagccaggugcaggcguaggaauauggacaucugguugcuuuggccugcugcccucuuucagggguccuaagcccacaaucaugccucccuaagaccuuggcauccuucccucuaagccguuggcaccucugugccaccucucacacuggcuccagacacacagccugugcuuuuggagcugagaucacucgcuucacccuccucaucuuuguucuccaaguaaagccacgaggucggggcgagggcagaggugaucaccugcgugucccaucuacagaccugcagcuucauaaaacuucugauuucucuucagcuuugaaaaggguuacccugggcacuggccuagagccucaccuccuaauagacuuagccccaugaguuugccauguugagcaggacuauuucuggcacuugcaagucccaugauuucuucgguaauucugaggguggggggagggacaugaaaucaucuuagcuuagcuuucugucugugaaugucuauauaguguauuguguguuuuaacaaaugauuuacacugacuguugcuguaaaagugaauuuggaaauaaaguuauuacucugauuaaa

SEQ ID NO: 7 - RNA, 5811 nt, Homo_Sapiens
ggacggccgagcggcagggcgcucgcgcgcgcccacuaguggccggaggagaaggcucccgcggaggccgcgcugcccgcccccuccccuggggaggcucgcguucccgcugcucgcgccugcgccgcccgccggccucaggaacgcgcccucuucgccggcgcgcgcccucgcagucaccgccacccaccagcuccggcaccaacagcagcgccgcugccaccgcccaccuucugccgccgccaccacagccaccuucuccuccuccgcuguccucucccguccucgccucugucgacuaucaggugaacuuugaaccaggauggcugagccccgccaggaguucgaagugauggaagaucacgcugggacguacggguugggggacaggaaagaucaggggggcuacaccaugcaccaagaccaagagggugacacggacgcuggccugaaagaaucuccccugcagacccccacugaggacggaucugaggaaccgggcucugaaaccucugaugcuaagagcacuccaacagcggaagaugugacagcacccuuaguggaugagggagcucccggcaagcaggcugccgcgcagccccacacggagaucccagaaggaaccacagcugaagaagcaggcauuggagacacccccagccuggaagacgaagcugcuggucacgugacccaagcucgcauggucaguaaaagcaaagacgggacuggaagcgaugacaaaaaagccaagggggcugaugguaaaacgaagaucgccacaccgcggggagcagccccuccaggccagaagggccaggccaacgccaccaggauuccagcaaaaaccccgcccgcuccaaagacaccacccagcucuggugaaccuccaaaaucaggggaucgcagcggcuacagcagccccggcuccccaggcacucccggcagccgcucccgcaccccgucccuuccaaccccacccacccgggagcccaagaagguggcagugguccguacuccacccaagucgccgucuuccgccaagagccgccugcagacagcccccgugcccaugccagaccugaagaaugucaaguccaagaucggcuccacugagaaccugaagcaccagccgggaggcgggaaggugcagauaauuaauaagaagcuggaucuuagcaacguccaguccaaguguggcucaaaggauaauaucaaacacgucccgggaggcggcagugugcaaauagucuacaaaccaguugaccugagcaaggugaccuccaaguguggcucauuaggcaacauccaucauaaaccaggagguggccagguggaaguaaaaucugagaagcuugacuucaaggacagaguccagucgaagauugggucccuggacaauaucacccacgucccuggcggaggaaauaaaaagauugaaacccacaagcugaccuuccgcgagaacgccaaagccaagacagaccacggggcggagaucguguacaagucgccaguggugucuggggacacgucuccacggcaucucagcaaugucuccuccaccggcagcaucgacaugguagacucgccccagcucgccacgcuagcugacgaggugucugccucccuggccaagcaggguuugugaucaggccccuggggcggucaauaauuguggagaggagagaaugagagaguguggaaaaaaaaagaauaaugacccggcccccgcccucugcccccagcugcuccucgcaguucgguuaauugguuaaucacuuaaccugcuuuugucacucggcuuuggcucgggacuucaaaaucagugaugggaguaagagcaaauuucaucuuuccaaauugaugggugggcuaguaauaaaauauuuaaaaaaaaacauucaaaaacauggccacauccaacauuuccucaggcaauuccuuuugauucuuuuuucuucccccuccauguagaagagggagaaggagaggcucugaaagcugcuucugggggauuucaagggacugggggugccaaccaccucuggcccuguugugggggugucacagaggcaguggcagcaacaaaggauuugaaacuugguguguucguggagccacaggcagacgaugucaaccuugugugagugugacggggguugggguggggcgggaggccacgggggaggccgaggcaggggcugggcagaggggagaggaagcacaagaagugggagugggagaggaagccacgugcuggagaguagacaucccccuccuugccgcugggagagccaaggccuaugccaccugcagcgucugagcggccgccuguccuugguggccgggggugggggccugcugugggucagugugccacccucugcagggcagccugugggagaagggacagcggguaaaaagagaaggcaagcuggcaggaggguggcacuucguggaugaccuccuuagaaaagacugaccuugaugucuugagagcgcuggccucuuccucccucccugcaggguagggggccugaguugaggggcuucccucugcuccacagaaacccuguuuuauugaguucugaagguuggaacugcugccaugauuuuggccacuuugcagaccugggacuuuagggcuaaccaguucucuuuguaaggacuugugccucuugggagacguccacccguuuccaagccugggccacuggcaucucuggagugugugggggucugggaggcaggucccgagcccccuguccuucccacggccacugcagucaccccgucugcgccgcugugcuguugucugccgugagagcccaaucacugccuauaccccucaucacacgucacaaugucccgaauucccagccucaccaccccuucucaguaaugacccugguugguugcaggagguaccuacuccauacugagggugaaauuaagggaaggcaaaguccaggcacaagagugggaccccagccucucacucucaguuccacucauccaacugggacccucaccacgaaucucaugaucugauucgguucccugucuccuccucccgucacagaugugagccagggcacugcucagcugugacccuagguguuucugccuuguugacauggagagagcccuuuccccugagaaggccuggccccuuccugugcugagcccacagcagcaggcugggugucuugguugucagugguggcaccaggauggaagggcaaggcacccagggcaggcccacagucccgcugucccccacuugcacccuagcuuguagcugccaaccucccagacagcccagcccgcugcucagcuccacaugcauaguaucagcccuccacacccgacaaaggggaacacacccccuuggaaaugguucuuuucccccagucccagcuggaagccaugcugucuguucugcuggagcagcugaacauauacauagauguugcccugcccuccccaucugcacccuguugaguuguaguuggauuugucuguuuaugcuuggauucaccagagugacuaugauagugaaaagaaaaaaaaaaaaaaaaaaggacgcauguaucuugaaaugcuuguaaagagguuucuaacccacccucacgaggugucucucacccccacacugggacucguguggccuguguggugccacccugcuggggccucccaaguuuugaaaggcuuuccucagcaccugggacccaacagagaccagcuucuagcagcuaaggaggccguucagcugugacgaaggccugaagcacaggauuaggacugaagcgaugauguccccuucccuacuuccccuuggggcucccugugucagggcacagacuaggucuuguggcuggucuggcuugcggcgcgaggaugguucucucuggucauagcccgaagucucauggcagucccaaaggaggcuuacaacuccugcaucacaagaaaaaggaagccacugccagcuggggggaucugcagcucccagaagcuccgugagccucagccaccccucagacuggguuccucuccaagcucgcccucuggaggggcagcgcagccucccaccaagggcccugcgaccacagcagggauugggaugaauugccuguccuggaucugcucuagaggcccaagcugccugccugaggaaggaugacuugacaagucaggagacacuguucccaaagccuugaccagagcaccucagcccgcugaccuugcacaaacuccaucugcugccaugagaaaagggaagccgccuuugcaaaacauugcugccuaaagaaacucagcagccucaggcccaauucugccacuucugguuuggguacaguuaaaggcaacccugagggacuuggcaguagaaauccagggccuccccuggggcuggcagcuucgugugcagcuagagcuuuaccugaaaggaagucucugggcccagaacucuccaccaagagccucccugccguucgcugagucccagcaauucuccuaaguugaagggaucugagaaggagaaggaaaugugggguagauuugguggugguuagagauaugccccccucauuacugccaacaguuucggcugcauuucuucacgcaccucgguuccucuuccugaaguucuugugcccugcucuucagcaccaugggccuucuuauacggaaggcucugggaucucccccuuguggggcaggcucuuggggccagccuaagaucaugguuuagggugaucagugcuggcagauaaauugaaaaggcacgcuggcuugugaucuuaaaugaggacaauccccccagggcugggcacuccuccccuccccucacuucucccaccugcagagccaguguccuugggugggcuagauaggauauacuguaugccggcuccuucaagcugcugacucacuuuaucaauaguuccauuuaaauugacuucaguggugagacuguauccuguuugcuauugcuuguugugcuauggggggaggggggaggaauguguaagauaguuaacaugggcaaagggagaucuuggggugcagcacuuaaacugccucguaacccuuuucaugauuucaaccacauuugcuagagggagggagcagccacggaguuagaggcccuugggguuucucuuuuccacugacaggcuuucccaggcagcuggcuaguucauucccuccccagccaggugcaggcguaggaauauggacaucugguugcuuuggccugcugcccucuuucagggguccuaagcccacaaucaugccucccuaagaccuuggcauccuucccucuaagccguuggcaccucugugccaccucucacacuggcuccagacacacagccugugcuuuuggagcugagaucacucgcuucacccuccucaucuuuguucuccaaguaaagccacgaggucggggcgagggcagaggugaucaccugcgugucccaucuacagaccugcagcuucauaaaacuucugauuucucuucagcuuugaaaaggguuacccugggcacuggccuagagccucaccuccuaauagacuuagccccaugaguuugccauguugagcaggacuauuucuggcacuugcaagucccaugauuucuucgguaauucugaggguggggggagggacaugaaaucaucuuagcuuagcuuucugucugugaaugucuauauaguguauuguguguuuuaacaaaugauuuacacugacuguugcuguaaaagugaauuuggaaauaaaguuauuacucugauuaaa

SEQ ID NO: 8 - RNA, 5637 nt, Homo_Sapiens
ggacggccgagcggcagggcgcucgcgcgcgcccacuaguggccggaggagaaggcucccgcggaggccgcgcugcccgcccccuccccuggggaggcucgcguucccgcugcucgcgccugcgccgcccgccggccucaggaacgcgcccucuucgccggcgcgcgcccucgcagucaccgccacccaccagcuccggcaccaacagcagcgccgcugccaccgcccaccuucugccgccgccaccacagccaccuucuccuccuccgcuguccucucccguccucgccucugucgacuaucaggugaacuuugaaccaggauggcugagccccgccaggaguucgaagugauggaagaucacgcugggacguacggguugggggacaggaaagaucaggggggcuacaccaugcaccaagaccaagagggugacacggacgcuggccugaaagcugaagaagcaggcauuggagacacccccagccuggaagacgaagcugcuggucacgugacccaagcucgcauggucaguaaaagcaaagacgggacuggaagcgaugacaaaaaagccaagggggcugaugguaaaacgaagaucgccacaccgcggggagcagccccuccaggccagaagggccaggccaacgccaccaggauuccagcaaaaaccccgcccgcuccaaagacaccacccagcucuggugaaccuccaaaaucaggggaucgcagcggcuacagcagccccggcuccccaggcacucccggcagccgcucccgcaccccgucccuuccaaccccacccacccgggagcccaagaagguggcagugguccguacuccacccaagucgccgucuuccgccaagagccgccugcagacagcccccgugcccaugccagaccugaagaaugucaaguccaagaucggcuccacugagaaccugaagcaccagccgggaggcgggaaggugcagauaauuaauaagaagcuggaucuuagcaacguccaguccaaguguggcucaaaggauaauaucaaacacgucccgggaggcggcagugugcaaauagucuacaaaccaguugaccugagcaaggugaccuccaaguguggcucauuaggcaacauccaucauaaaccaggagguggccagguggaaguaaaaucugagaagcuugacuucaaggacagaguccagucgaagauugggucccuggacaauaucacccacgucccuggcggaggaaauaaaaagauugaaacccacaagcugaccuuccgcgagaacgccaaagccaagacagaccacggggcggagaucguguacaagucgccaguggugucuggggacacgucuccacggcaucucagcaaugucuccuccaccggcagcaucgacaugguagacucgccccagcucgccacgcuagcugacgaggugucugccucccuggccaagcaggguuugugaucaggccccuggggcggucaauaauuguggagaggagagaaugagagaguguggaaaaaaaaagaauaaugacccggcccccgcccucugcccccagcugcuccucgcaguucgguuaauugguuaaucacuuaaccugcuuuugucacucggcuuuggcucgggacuucaaaaucagugaugggaguaagagcaaauuucaucuuuccaaauugaugggugggcuaguaauaaaauauuuaaaaaaaaacauucaaaaacauggccacauccaacauuuccucaggcaauuccuuuugauucuuuuuucuucccccuccauguagaagagggagaaggagaggcucugaaagcugcuucugggggauuucaagggacugggggugccaaccaccucuggcccuguugugggggugucacagaggcaguggcagcaacaaaggauuugaaacuugguguguucguggagccacaggcagacgaugucaaccuugugugagugugacggggguugggguggggcgggaggccacgggggaggccgaggcaggggcugggcagaggggagaggaagcacaagaagugggagugggagaggaagccacgugcuggagaguagacaucccccuccuugccgcugggagagccaaggccuaugccaccugcagcgucugagcggccgccuguccuugguggccgggggugggggccugcugugggucagugugccacccucugcagggcagccugugggagaagggacagcggguaaaaagagaaggcaagcuggcaggaggguggcacuucguggaugaccuccuuagaaaagacugaccuugaugucuugagagcgcuggccucuuccucccucccugcaggguagggggccugaguugaggggcuucccucugcuccacagaaacccuguuuuauugaguucugaagguuggaacugcugccaugauuuuggccacuuugcagaccugggacuuuagggcuaaccaguucucuuuguaaggacuugugccucuugggagacguccacccguuuccaagccugggccacuggcaucucuggagugugugggggucugggaggcaggucccgagcccccuguccuucccacggccacugcagucaccccgucugcgccgcugugcuguugucugccgugagagcccaaucacugccuauaccccucaucacacgucacaaugucccgaauucccagccucaccaccccuucucaguaaugacccugguugguugcaggagguaccuacuccauacugagggugaaauuaagggaaggcaaaguccaggcacaagagugggaccccagccucucacucucaguuccacucauccaacugggacccucaccacgaaucucaugaucugauucgguucccugucuccuccucccgucacagaugugagccagggcacugcucagcugugacccuagguguuucugccuuguugacauggagagagcccuuuccccugagaaggccuggccccuuccugugcugagcccacagcagcaggcugggugucuugguugucagugguggcaccaggauggaagggcaaggcacccagggcaggcccacagucccgcugucccccacuugcacccuagcuuguagcugccaaccucccagacagcccagcccgcugcucagcuccacaugcauaguaucagcccuccacacccgacaaaggggaacacacccccuuggaaaugguucuuuucccccagucccagcuggaagccaugcugucuguucugcuggagcagcugaacauauacauagauguugcccugcccuccccaucugcacccuguugaguuguaguuggauuugucuguuuaugcuuggauucaccagagugacuaugauagugaaaagaaaaaaaaaaaaaaaaaaggacgcauguaucuugaaaugcuuguaaagagguuucuaacccacccucacgaggugucucucacccccacacugggacucguguggccuguguggugccacccugcuggggccucccaaguuuugaaaggcuuuccucagcaccugggacccaacagagaccagcuucuagcagcuaaggaggccguucagcugugacgaaggccugaagcacaggauuaggacugaagcgaugauguccccuucccuacuuccccuuggggcucccugugucagggcacagacuaggucuuguggcuggucuggcuugcggcgcgaggaugguucucucuggucauagcccgaagucucauggcagucccaaaggaggcuuacaacuccugcaucacaagaaaaaggaagccacugccagcuggggggaucugcagcucccagaagcuccgugagccucagccaccccucagacuggguuccucuccaagcucgcccucuggaggggcagcgcagccucccaccaagggcccugcgaccacagcagggauugggaugaauugccuguccuggaucugcucuagaggcccaagcugccugccugaggaaggaugacuugacaagucaggagacacuguucccaaagccuugaccagagcaccucagcccgcugaccuugcacaaacuccaucugcugccaugagaaaagggaagccgccuuugcaaaacauugcugccuaaagaaacucagcagccucaggcccaauucugccacuucugguuuggguacaguuaaaggcaacccugagggacuuggcaguagaaauccagggccuccccuggggcuggcagcuucgugugcagcuagagcuuuaccugaaaggaagucucugggcccagaacucuccaccaagagccucccugccguucgcugagucccagcaauucuccuaaguugaagggaucugagaaggagaaggaaaugugggguagauuugguggugguuagagauaugccccccucauuacugccaacaguuucggcugcauuucuucacgcaccucgguuccucuuccugaaguucuugugcccugcucuucagcaccaugggccuucuuauacggaaggcucugggaucucccccuuguggggcaggcucuuggggccagccuaagaucaugguuuagggugaucagugcuggcagauaaauugaaaaggcacgcuggcuugugaucuuaaaugaggacaauccccccagggcugggcacuccuccccuccccucacuucucccaccugcagagccaguguccuugggugggcuagauaggauauacuguaugccggcuccuucaagcugcugacucacuuuaucaauaguuccauuuaaauugacuucaguggugagacuguauccuguuugcuauugcuuguugugcuauggggggaggggggaggaauguguaagauaguuaacaugggcaaagggagaucuuggggugcagcacuuaaacugccucguaacccuuuucaugauuucaaccacauuugcuagagggagggagcagccacggaguuagaggcccuugggguuucucuuuuccacugacaggcuuucccaggcagcuggcuaguucauucccuccccagccaggugcaggcguaggaauauggacaucugguugcuuuggccugcugcccucuuucagggguccuaagcccacaaucaugccucccuaagaccuuggcauccuucccucuaagccguuggcaccucugugccaccucucacacuggcuccagacacacagccugugcuuuuggagcugagaucacucgcuucacccuccucaucuuuguucuccaaguaaagccacgaggucggggcgagggcagaggugaucaccugcgugucccaucuacagaccugcagcuucauaaaacuucugauuucucuucagcuuugaaaaggguuacccugggcacuggccuagagccucaccuccuaauagacuuagccccaugaguuugccauguugagcaggacuauuucuggcacuugcaagucccaugauuucuucgguaauucugaggguggggggagggacaugaaaucaucuuagcuuagcuuucugucugugaaugucuauauaguguauuguguguuuuaacaaaugauuuacacugacuguugcuguaaaagugaauuuggaaauaaaguuauuacucugauuaaa

SEQ ID NO: 9 - RNA, 5544 nt, Homo_Sapiens
ggacggccgagcggcagggcgcucgcgcgcgcccacuaguggccggaggagaaggcucccgcggaggccgcgcugcccgcccccuccccuggggaggcucgcguucccgcugcucgcgccugcgccgcccgccggccucaggaacgcgcccucuucgccggcgcgcgcccucgcagucaccgccacccaccagcuccggcaccaacagcagcgccgcugccaccgcccaccuucugccgccgccaccacagccaccuucuccuccuccgcuguccucucccguccucgccucugucgacuaucaggugaacuuugaaccaggauggcugagccccgccaggaguucgaagugauggaagaucacgcugggacguacggguugggggacaggaaagaucaggggggcuacaccaugcaccaagaccaagagggugacacggacgcuggccugaaagcugaagaagcaggcauuggagacacccccagccuggaagacgaagcugcuggucacgugacccaagcucgcauggucaguaaaagcaaagacgggacuggaagcgaugacaaaaaagccaagggggcugaugguaaaacgaagaucgccacaccgcggggagcagccccuccaggccagaagggccaggccaacgccaccaggauuccagcaaaaaccccgcccgcuccaaagacaccacccagcucuggugaaccuccaaaaucaggggaucgcagcggcuacagcagccccggcuccccaggcacucccggcagccgcucccgcaccccgucccuuccaaccccacccacccgggagcccaagaagguggcagugguccguacuccacccaagucgccgucuuccgccaagagccgccugcagacagcccccgugcccaugccagaccugaagaaugucaaguccaagaucggcuccacugagaaccugaagcaccagccgggaggcgggaaggugcaaauagucuacaaaccaguugaccugagcaaggugaccuccaaguguggcucauuaggcaacauccaucauaaaccaggagguggccagguggaaguaaaaucugagaagcuugacuucaaggacagaguccagucgaagauugggucccuggacaauaucacccacgucccuggcggaggaaauaaaaagauugaaacccacaagcugaccuuccgcgagaacgccaaagccaagacagaccacggggcggagaucguguacaagucgccaguggugucuggggacacgucuccacggcaucucagcaaugucuccuccaccggcagcaucgacaugguagacucgccccagcucgccacgcuagcugacgaggugucugccucccuggccaagcaggguuugugaucaggccccuggggcggucaauaauuguggagaggagagaaugagagaguguggaaaaaaaaagaauaaugacccggcccccgcccucugcccccagcugcuccucgcaguucgguuaauugguuaaucacuuaaccugcuuuugucacucggcuuuggcucgggacuucaaaaucagugaugggaguaagagcaaauuucaucuuuccaaauugaugggugggcuaguaauaaaauauuuaaaaaaaaacauucaaaaacauggccacauccaacauuuccucaggcaauuccuuuugauucuuuuuucuucccccuccauguagaagagggagaaggagaggcucugaaagcugcuucugggggauuucaagggacugggggugccaaccaccucuggcccuguugugggggugucacagaggcaguggcagcaacaaaggauuugaaacuugguguguucguggagccacaggcagacgaugucaaccuugugugagugugacggggguugggguggggcgggaggccacgggggaggccgaggcaggggcugggcagaggggagaggaagcacaagaagugggagugggagaggaagccacgugcuggagaguagacaucccccuccuugccgcugggagagccaaggccuaugccaccugcagcgucugagcggccgccuguccuugguggccgggggugggggccugcugugggucagugugccacccucugcagggcagccugugggagaagggacagcggguaaaaagagaaggcaagcuggcaggaggguggcacuucguggaugaccuccuuagaaaagacugaccuugaugucuugagagcgcuggccucuuccucccucccugcaggguagggggccugaguugaggggcuucccucugcuccacagaaacccuguuuuauugaguucugaagguuggaacugcugccaugauuuuggccacuuugcagaccugggacuuuagggcuaaccaguucucuuuguaaggacuugugccucuugggagacguccacccguuuccaagccugggccacuggcaucucuggagugugugggggucugggaggcaggucccgagcccccuguccuucccacggccacugcagucaccccgucugcgccgcugugcuguugucugccgugagagcccaaucacugccuauaccccucaucacacgucacaaugucccgaauucccagccucaccaccccuucucaguaaugacccugguugguugcaggagguaccuacuccauacugagggugaaauuaagggaaggcaaaguccaggcacaagagugggaccccagccucucacucucaguuccacucauccaacugggacccucaccacgaaucucaugaucugauucgguucccugucuccuccucccgucacagaugugagccagggcacugcucagcugugacccuagguguuucugccuuguugacauggagagagcccuuuccccugagaaggccuggccccuuccugugcugagcccacagcagcaggcugggugucuugguugucagugguggcaccaggauggaagggcaaggcacccagggcaggcccacagucccgcugucccccacuugcacccuagcuuguagcugccaaccucccagacagcccagcccgcugcucagcuccacaugcauaguaucagcccuccacacccgacaaaggggaacacacccccuuggaaaugguucuuuucccccagucccagcuggaagccaugcugucuguucugcuggagcagcugaacauauacauagauguugcccugcccuccccaucugcacccuguugaguuguaguuggauuugucuguuuaugcuuggauucaccagagugacuaugauagugaaaagaaaaaaaaaaaaaaaaaaggacgcauguaucuugaaaugcuuguaaagagguuucuaacccacccucacgaggugucucucacccccacacugggacucguguggccuguguggugccacccugcuggggccucccaaguuuugaaaggcuuuccucagcaccugggacccaacagagaccagcuucuagcagcuaaggaggccguucagcugugacgaaggccugaagcacaggauuaggacugaagcgaugauguccccuucccuacuuccccuuggggcucccugugucagggcacagacuaggucuuguggcuggucuggcuugcggcgcgaggaugguucucucuggucauagcccgaagucucauggcagucccaaaggaggcuuacaacuccugcaucacaagaaaaaggaagccacugccagcuggggggaucugcagcucccagaagcuccgugagccucagccaccccucagacuggguuccucuccaagcucgcccucuggaggggcagcgcagccucccaccaagggcccugcgaccacagcagggauugggaugaauugccuguccuggaucugcucuagaggcccaagcugccugccugaggaaggaugacuugacaagucaggagacacuguucccaaagccuugaccagagcaccucagcccgcugaccuugcacaaacuccaucugcugccaugagaaaagggaagccgccuuugcaaaacauugcugccuaaagaaacucagcagccucaggcccaauucugccacuucugguuuggguacaguuaaaggcaacccugagggacuuggcaguagaaauccagggccuccccuggggcuggcagcuucgugugcagcuagagcuuuaccugaaaggaagucucugggcccagaacucuccaccaagagccucccugccguucgcugagucccagcaauucuccuaaguugaagggaucugagaaggagaaggaaaugugggguagauuugguggugguuagagauaugccccccucauuacugccaacaguuucggcugcauuucuucacgcaccucgguuccucuuccugaaguucuugugcccugcucuucagcaccaugggccuucuuauacggaaggcucugggaucucccccuuguggggcaggcucuuggggccagccuaagaucaugguuuagggugaucagugcuggcagauaaauugaaaaggcacgcuggcuugugaucuuaaaugaggacaauccccccagggcugggcacuccuccccuccccucacuucucccaccugcagagccaguguccuugggugggcuagauaggauauacuguaugccggcuccuucaagcugcugacucacuuuaucaauaguuccauuuaaauugacuucaguggugagacuguauccuguuugcuauugcuuguugugcuauggggggaggggggaggaauguguaagauaguuaacaugggcaaagggagaucuuggggugcagcacuuaaacugccucguaacccuuuucaugauuucaaccacauuugcuagagggagggagcagccacggaguuagaggcccuugggguuucucuuuuccacugacaggcuuucccaggcagcuggcuaguucauucccuccccagccaggugcaggcguaggaauauggacaucugguugcuuuggccugcugcccucuuucagggguccuaagcccacaaucaugccucccuaagaccuuggcauccuucccucuaagccguuggcaccucugugccaccucucacacuggcuccagacacacagccugugcuuuuggagcugagaucacucgcuucacccuccucaucuuuguucuccaaguaaagccacgaggucggggcgagggcagaggugaucaccugcgugucccaucuacagaccugcagcuucauaaaacuucugauuucucuucagcuuugaaaaggguuacccugggcacuggccuagagccucaccuccuaauagacuuagccccaugaguuugccauguugagcaggacuauuucuggcacuugcaagucccaugauuucuucgguaauucugaggguggggggagggacaugaaaucaucuuagcuuagcuuucugucugugaaugucuauauaguguauuguguguuuuaacaaaugauuuacacugacuguugcuguaaaagugaauuuggaaauaaaguuauuacucugauuaaa

SEQ ID NO: 10 - RNA, 5724 nt, Homo_Sapiens
ggacggccgagcggcagggcgcucgcgcgcgcccacuaguggccggaggagaaggcucccgcggaggccgcgcugcccgcccccuccccuggggaggcucgcguucccgcugcucgcgccugcgccgcccgccggccucaggaacgcgcccucuucgccggcgcgcgcccucgcagucaccgccacccaccagcuccggcaccaacagcagcgccgcugccaccgcccaccuucugccgccgccaccacagccaccuucuccuccuccgcuguccucucccguccucgccucugucgacuaucaggugaacuuugaaccaggauggcugagccccgccaggaguucgaagugauggaagaucacgcugggacguacggguugggggacaggaaagaucaggggggcuacaccaugcaccaagaccaagagggugacacggacgcuggccugaaagaaucuccccugcagacccccacugaggacggaucugaggaaccgggcucugaaaccucugaugcuaagagcacuccaacagcggaagcugaagaagcaggcauuggagacacccccagccuggaagacgaagcugcuggucacgugacccaagcucgcauggucaguaaaagcaaagacgggacuggaagcgaugacaaaaaagccaagggggcugaugguaaaacgaagaucgccacaccgcggggagcagccccuccaggccagaagggccaggccaacgccaccaggauuccagcaaaaaccccgcccgcuccaaagacaccacccagcucuggugaaccuccaaaaucaggggaucgcagcggcuacagcagccccggcuccccaggcacucccggcagccgcucccgcaccccgucccuuccaaccccacccacccgggagcccaagaagguggcagugguccguacuccacccaagucgccgucuuccgccaagagccgccugcagacagcccccgugcccaugccagaccugaagaaugucaaguccaagaucggcuccacugagaaccugaagcaccagccgggaggcgggaaggugcagauaauuaauaagaagcuggaucuuagcaacguccaguccaaguguggcucaaaggauaauaucaaacacgucccgggaggcggcagugugcaaauagucuacaaaccaguugaccugagcaaggugaccuccaaguguggcucauuaggcaacauccaucauaaaccaggagguggccagguggaaguaaaaucugagaagcuugacuucaaggacagaguccagucgaagauugggucccuggacaauaucacccacgucccuggcggaggaaauaaaaagauugaaacccacaagcugaccuuccgcgagaacgccaaagccaagacagaccacggggcggagaucguguacaagucgccaguggugucuggggacacgucuccacggcaucucagcaaugucuccuccaccggcagcaucgacaugguagacucgccccagcucgccacgcuagcugacgaggugucugccucccuggccaagcaggguuugugaucaggccccuggggcggucaauaauuguggagaggagagaaugagagaguguggaaaaaaaaagaauaaugacccggcccccgcccucugcccccagcugcuccucgcaguucgguuaauugguuaaucacuuaaccugcuuuugucacucggcuuuggcucgggacuucaaaaucagugaugggaguaagagcaaauuucaucuuuccaaauugaugggugggcuaguaauaaaauauuuaaaaaaaaacauucaaaaacauggccacauccaacauuuccucaggcaauuccuuuugauucuuuuuucuucccccuccauguagaagagggagaaggagaggcucugaaagcugcuucugggggauuucaagggacugggggugccaaccaccucuggcccuguugugggggugucacagaggcaguggcagcaacaaaggauuugaaacuugguguguucguggagccacaggcagacgaugucaaccuugugugagugugacggggguugggguggggcgggaggccacgggggaggccgaggcaggggcugggcagaggggagaggaagcacaagaagugggagugggagaggaagccacgugcuggagaguagacaucccccuccuugccgcugggagagccaaggccuaugccaccugcagcgucugagcggccgccuguccuugguggccgggggugggggccugcugugggucagugugccacccucugcagggcagccugugggagaagggacagcggguaaaaagagaaggcaagcuggcaggaggguggcacuucguggaugaccuccuuagaaaagacugaccuugaugucuugagagcgcuggccucuuccucccucccugcaggguagggggccugaguugaggggcuucccucugcuccacagaaacccuguuuuauugaguucugaagguuggaacugcugccaugauuuuggccacuuugcagaccugggacuuuagggcuaaccaguucucuuuguaaggacuugugccucuugggagacguccacccguuuccaagccugggccacuggcaucucuggagugugugggggucugggaggcaggucccgagcccccuguccuucccacggccacugcagucaccccgucugcgccgcugugcuguugucugccgugagagcccaaucacugccuauaccccucaucacacgucacaaugucccgaauucccagccucaccaccccuucucaguaaugacccugguugguugcaggagguaccuacuccauacugagggugaaauuaagggaaggcaaaguccaggcacaagagugggaccccagccucucacucucaguuccacucauccaacugggacccucaccacgaaucucaugaucugauucgguucccugucuccuccucccgucacagaugugagccagggcacugcucagcugugacccuagguguuucugccuuguugacauggagagagcccuuuccccugagaaggccuggccccuuccugugcugagcccacagcagcaggcugggugucuugguugucagugguggcaccaggauggaagggcaaggcacccagggcaggcccacagucccgcugucccccacuugcacccuagcuuguagcugccaaccucccagacagcccagcccgcugcucagcuccacaugcauaguaucagcccuccacacccgacaaaggggaacacacccccuuggaaaugguucuuuucccccagucccagcuggaagccaugcugucuguucugcuggagcagcugaacauauacauagauguugcccugcccuccccaucugcacccuguugaguuguaguuggauuugucuguuuaugcuuggauucaccagagugacuaugauagugaaaagaaaaaaaaaaaaaaaaaaggacgcauguaucuugaaaugcuuguaaagagguuucuaacccacccucacgaggugucucucacccccacacugggacucguguggccuguguggugccacccugcuggggccucccaaguuuugaaaggcuuuccucagcaccugggacccaacagagaccagcuucuagcagcuaaggaggccguucagcugugacgaaggccugaagcacaggauuaggacugaagcgaugauguccccuucccuacuuccccuuggggcucccugugucagggcacagacuaggucuuguggcuggucuggcuugcggcgcgaggaugguucucucuggucauagcccgaagucucauggcagucccaaaggaggcuuacaacuccugcaucacaagaaaaaggaagccacugccagcuggggggaucugcagcucccagaagcuccgugagccucagccaccccucagacuggguuccucuccaagcucgcccucuggaggggcagcgcagccucccaccaagggcccugcgaccacagcagggauugggaugaauugccuguccuggaucugcucuagaggcccaagcugccugccugaggaaggaugacuugacaagucaggagacacuguucccaaagccuugaccagagcaccucagcccgcugaccuugcacaaacuccaucugcugccaugagaaaagggaagccgccuuugcaaaacauugcugccuaaagaaacucagcagccucaggcccaauucugccacuucugguuuggguacaguuaaaggcaacccugagggacuuggcaguagaaauccagggccuccccuggggcuggcagcuucgugugcagcuagagcuuuaccugaaaggaagucucugggcccagaacucuccaccaagagccucccugccguucgcugagucccagcaauucuccuaaguugaagggaucugagaaggagaaggaaaugugggguagauuugguggugguuagagauaugccccccucauuacugccaacaguuucggcugcauuucuucacgcaccucgguuccucuuccugaaguucuugugcccugcucuucagcaccaugggccuucuuauacggaaggcucugggaucucccccuuguggggcaggcucuuggggccagccuaagaucaugguuuagggugaucagugcuggcagauaaauugaaaaggcacgcuggcuugugaucuuaaaugaggacaauccccccagggcugggcacuccuccccuccccucacuucucccaccugcagagccaguguccuugggugggcuagauaggauauacuguaugccggcuccuucaagcugcugacucacuuuaucaauaguuccauuuaaauugacuucaguggugagacuguauccuguuugcuauugcuuguugugcuauggggggaggggggaggaauguguaagauaguuaacaugggcaaagggagaucuuggggugcagcacuuaaacugccucguaacccuuuucaugauuucaaccacauuugcuagagggagggagcagccacggaguuagaggcccuugggguuucucuuuuccacugacaggcuuucccaggcagcuggcuaguucauucccuccccagccaggugcaggcguaggaauauggacaucugguugcuuuggccugcugcccucuuucagggguccuaagcccacaaucaugccucccuaagaccuuggcauccuucccucuaagccguuggcaccucugugccaccucucacacuggcuccagacacacagccugugcuuuuggagcugagaucacucgcuucacccuccucaucuuuguucuccaaguaaagccacgaggucggggcgagggcagaggugaucaccugcgugucccaucuacagaccugcagcuucauaaaacuucugauuucucuucagcuuugaaaaggguuacccugggcacuggccuagagccucaccuccuaauagacuuagccccaugaguuugccauguugagcaggacuauuucuggcacuugcaagucccaugauuucuucgguaauucugaggguggggggagggacaugaaaucaucuuagcuuagcuuucugucugugaaugucuauauaguguauuguguguuuuaacaaaugauuuacacugacuguugcuguaaaagugaauuuggaaauaaaguuauuacucugauuaaa

SEQ ID NO: 11 - RNA, 6816 nt, Homo_Sapiens
ggacggccgagcggcagggcgcucgcgcgcgcccacuaguggccggaggagaaggcucccgcggaggccgcgcugcccgcccccuccccuggggaggcucgcguucccgcugcucgcgccugcgccgcccgccggccucaggaacgcgcccucuucgccggcgcgcgcccucgcagucaccgccacccaccagcuccggcaccaacagcagcgccgcugccaccgcccaccuucugccgccgccaccacagccaccuucuccuccuccgcuguccucucccguccucgccucugucgacuaucaggugaacuuugaaccaggauggcugagccccgccaggaguucgaagugauggaagaucacgcugggacguacggguugggggacaggaaagaucaggggggcuacaccaugcaccaagaccaagagggugacacggacgcuggccugaaagaaucuccccugcagacccccacugaggacggaucugaggaaccgggcucugaaaccucugaugcuaagagcacuccaacagcggaagaugugacagcacccuuaguggaugagggagcucccggcaagcaggcugccgcgcagccccacacggagaucccagaaggaaccacagcugaagaagcaggcauuggagacacccccagccuggaagacgaagcugcuggucacgugacccaagagccugaaagugguaaggugguccaggaaggcuuccuccgagagccaggccccccaggucugagccaccagcucauguccggcaugccuggggcuccccuccugccugagggccccagagaggccacacgccaaccuucggggacaggaccugaggacacagagggcggccgccacgccccugagcugcucaagcaccagcuucuaggagaccugcaccaggaggggccgccgcugaagggggcagggggcaaagagaggccggggagcaaggaggagguggaugaagaccgcgacgucgaugaguccuccccccaagacuccccucccuccaaggccuccccagcccaagaugggcggccuccccagacagccgccagagaagccaccagcaucccaggcuucccagcggagggugccaucccccucccuguggauuuccucuccaaaguuuccacagagaucccagccucagagcccgacgggcccaguguagggcgggccaaagggcaggaugccccccuggaguucacguuucacguggaaaucacacccaacgugcagaaggagcaggcgcacucggaggagcauuugggaagggcugcauuuccaggggccccuggagaggggccagaggcccggggccccucuuugggagaggacacaaaagaggcugaccuuccagagcccucugaaaagcagccugcugcugcuccgcgggggaagcccgucagccgggucccucaacucaaagcucgcauggucaguaaaagcaaagacgggacuggaagcgaugacaaaaaagccaagacauccacacguuccucugcuaaaaccuugaaaaauaggccuugccuuagccccaaacaccccacuccugguagcucagacccucugauccaacccuccagcccugcugugugcccagagccaccuuccucuccuaaauacgucucuucugucacuucccgaacuggcaguucuggagcaaaggagaugaaacucaagggggcugaugguaaaacgaagaucgccacaccgcggggagcagccccuccaggccagaagggccaggccaacgccaccaggauuccagcaaaaaccccgcccgcuccaaagacaccacccagcucugcgacuaagcaaguccagagaagaccacccccugcagggcccagaucugagagaggugaaccuccaaaaucaggggaucgcagcggcuacagcagccccggcuccccaggcacucccggcagccgcucccgcaccccgucccuuccaaccccacccacccgggagcccaagaagguggcagugguccguacuccacccaagucgccgucuuccgccaagagccgccugcagacagcccccgugcccaugccagaccugaagaaugucaaguccaagaucggcuccacugagaaccugaagcaccagccgggaggcgggaaggugcagauaauuaauaagaagcuggaucuuagcaacguccaguccaaguguggcucaaaggauaauaucaaacacgucccgggaggcggcagugugcaaauagucuacaaaccaguugaccugagcaaggugaccuccaaguguggcucauuaggcaacauccaucauaaaccaggagguggccagguggaaguaaaaucugagaagcuugacuucaaggacagaguccagucgaagauugggucccuggacaauaucacccacgucccuggcggaggaaauaaaaagauugaaacccacaagcugaccuuccgcgagaacgccaaagccaagacagaccacggggcggagaucguguacaagucgccaguggugucuggggacacgucuccacggcaucucagcaaugucuccuccaccggcagcaucgacaugguagacucgccccagcucgccacgcuagcugacgaggugucugccucccuggccaagcaggguuugugaucaggccccuggggcggucaauaauuguggagaggagagaaugagagaguguggaaaaaaaaagaauaaugacccggcccccgcccucugcccccagcugcuccucgcaguucgguuaauugguuaaucacuuaaccugcuuuugucacucggcuuuggcucgggacuucaaaaucagugaugggaguaagagcaaauuucaucuuuccaaauugaugggugggcuaguaauaaaauauuuaaaaaaaaacauucaaaaacauggccacauccaacauuuccucaggcaauuccuuuugauucuuuuuucuucccccuccauguagaagagggagaaggagaggcucugaaagcugcuucugggggauuucaagggacugggggugccaaccaccucuggcccuguugugggggugucacagaggcaguggcagcaacaaaggauuugaaacuugguguguucguggagccacaggcagacgaugucaaccuugugugagugugacggggguugggguggggcgggaggccacgggggaggccgaggcaggggcugggcagaggggagaggaagcacaagaagugggagugggagaggaagccacgugcuggagaguagacaucccccuccuugccgcugggagagccaaggccuaugccaccugcagcgucugagcggccgccuguccuugguggccgggggugggggccugcugugggucagugugccacccucugcagggcagccugugggagaagggacagcggguaaaaagagaaggcaagcuggcaggaggguggcacuucguggaugaccuccuuagaaaagacugaccuugaugucuugagagcgcuggccucuuccucccucccugcaggguagggggccugaguugaggggcuucccucugcuccacagaaacccuguuuuauugaguucugaagguuggaacugcugccaugauuuuggccacuuugcagaccugggacuuuagggcuaaccaguucucuuuguaaggacuugugccucuugggagacguccacccguuuccaagccugggccacuggcaucucuggagugugugggggucugggaggcaggucccgagcccccuguccuucccacggccacugcagucaccccgucugcgccgcugugcuguugucugccgugagagcccaaucacugccuauaccccucaucacacgucacaaugucccgaauucccagccucaccaccccuucucaguaaugacccugguugguugcaggagguaccuacuccauacugagggugaaauuaagggaaggcaaaguccaggcacaagagugggaccccagccucucacucucaguuccacucauccaacugggacccucaccacgaaucucaugaucugauucgguucccugucuccuccucccgucacagaugugagccagggcacugcucagcugugacccuagguguuucugccuuguugacauggagagagcccuuuccccugagaaggccuggccccuuccugugcugagcccacagcagcaggcugggugucuugguugucagugguggcaccaggauggaagggcaaggcacccagggcaggcccacagucccgcugucccccacuugcacccuagcuuguagcugccaaccucccagacagcccagcccgcugcucagcuccacaugcauaguaucagcccuccacacccgacaaaggggaacacacccccuuggaaaugguucuuuucccccagucccagcuggaagccaugcugucuguucugcuggagcagcugaacauauacauagauguugcccugcccuccccaucugcacccuguugaguuguaguuggauuugucuguuuaugcuuggauucaccagagugacuaugauagugaaaagaaaaaaaaaaaaaaaaaaggacgcauguaucuugaaaugcuuguaaagagguuucuaacccacccucacgaggugucucucacccccacacugggacucguguggccuguguggugccacccugcuggggccucccaaguuuugaaaggcuuuccucagcaccugggacccaacagagaccagcuucuagcagcuaaggaggccguucagcugugacgaaggccugaagcacaggauuaggacugaagcgaugauguccccuucccuacuuccccuuggggcucccugugucagggcacagacuaggucuuguggcuggucuggcuugcggcgcgaggaugguucucucuggucauagcccgaagucucauggcagucccaaaggaggcuuacaacuccugcaucacaagaaaaaggaagccacugccagcuggggggaucugcagcucccagaagcuccgugagccucagccaccccucagacuggguuccucuccaagcucgcccucuggaggggcagcgcagccucccaccaagggcccugcgaccacagcagggauugggaugaauugccuguccuggaucugcucuagaggcccaagcugccugccugaggaaggaugacuugacaagucaggagacacuguucccaaagccuugaccagagcaccucagcccgcugaccuugcacaaacuccaucugcugccaugagaaaagggaagccgccuuugcaaaacauugcugccuaaagaaacucagcagccucaggcccaauucugccacuucugguuuggguacaguuaaaggcaacccugagggacuuggcaguagaaauccagggccuccccuggggcuggcagcuucgugugcagcuagagcuuuaccugaaaggaagucucugggcccagaacucuccaccaagagccucccugccguucgcugagucccagcaauucuccuaaguugaagggaucugagaaggagaaggaaaugugggguagauuugguggugguuagagauaugccccccucauuacugccaacaguuucggcugcauuucuucacgcaccucgguuccucuuccugaaguucuugugcccugcucuucagcaccaugggccuucuuauacggaaggcucugggaucucccccuuguggggcaggcucuuggggccagccuaagaucaugguuuagggugaucagugcuggcagauaaauugaaaaggcacgcuggcuugugaucuuaaaugaggacaauccccccagggcugggcacuccuccccuccccucacuucucccaccugcagagccaguguccuugggugggcuagauaggauauacuguaugccggcuccuucaagcugcugacucacuuuaucaauaguuccauuuaaauugacuucaguggugagacuguauccuguuugcuauugcuuguugugcuauggggggaggggggaggaauguguaagauaguuaacaugggcaaagggagaucuuggggugcagcacuuaaacugccucguaacccuuuucaugauuucaaccacauuugcuagagggagggagcagccacggaguuagaggcccuugggguuucucuuuuccacugacaggcuuucccaggcagcuggcuaguucauucccuccccagccaggugcaggcguaggaauauggacaucugguugcuuuggccugcugcccucuuucagggguccuaagcccacaaucaugccucccuaagaccuuggcauccuucccucuaagccguuggcaccucugugccaccucucacacuggcuccagacacacagccugugcuuuuggagcugagaucacucgcuucacccuccucaucuuuguucuccaaguaaagccacgaggucggggcgagggcagaggugaucaccugcgugucccaucuacagaccugcagcuucauaaaacuucugauuucucuucagcuuugaaaaggguuacccugggcacuggccuagagccucaccuccuaauagacuuagccccaugaguuugccauguugagcaggacuauuucuggcacuugcaagucccaugauuucuucgguaauucugaggguggggggagggacaugaaaucaucuuagcuuagcuuucugucugugaaugucuauauaguguauuguguguuuuaacaaaugauuuacacugacuguugcuguaaaagugaauuuggaaauaaaguuauuacucugauuaaa

SEQ ID NO: 12 - RNA, 981 nt, Homo_Sapiens
guuuggggccagagugggcgaggcgcggaggucuggccuauaaaguagucgcggagacggggugcugguuugcgucguagucuccugcagcgucugggguuuccguugcaguccucggaaccaggaccucggcguggccuagcgaguuauggcgacgaaggccgugugcgugcugaagggcgacggcccagugcagggcaucaucaauuucgagcagaaggaaaguaauggaccagugaagguguggggaagcauuaaaggacugacugaaggccugcauggauuccauguucaugaguuuggagauaauacagcaggcuguaccagugcagguccucacuuuaauccucuauccagaaaacacggugggccaaaggaugaagagaggcauguuggagacuugggcaaugugacugcugacaaagaugguguggccgaugugucuauugaagauucugugaucucacucucaggagaccauugcaucauuggccgcacacuggugguccaugaaaaagcagaugacuugggcaaagguggaaaugaagaaaguacaaagacaggaaacgcuggaagucguuuggcuugugguguaauugggaucgcccaauaaacauucccuuggauguagucugaggccccuuaacucaucuguuauccugcuagcuguagaaauguauccugauaaacauuaaacacuguaaucuuaaaaguguaauugugugacuuuuucagaguugcuuuaaaguaccuguagugagaaacugauuuaugaucacuuggaagauuuguauaguuuuauaaaacucaguuaaaaugucuguuucaaugaccuguauuuugccagacuuaaaucacagauggguauuaaacuugucagaauuucuuugucauucaagccugugaauaaaaacccuguauggcacuuauuaugaggcuauuaaaagaauccaaauucaaacuaaaaaaaaaaaaaaaaaa

SEQ ID NO: 13 - RNA, 5850 nt, Homo_Sapiens
acaagucuuuccgccuccccagcccgcccgggagcugcgagccgcgagcuggauuaugguggccugagcagccaacgcagccgcaggagcccggagcccuugccccugcccgcgccgccgcccgccggggggaccagggaagccgccaccggcccgccaugcccgccccucccagccccgccgggagcccgcgcccgcugcccaggcuggccgccgccgugccgauguagcgggcuccggaucccagccucuccccugcucccgugcucugcggaucuccccugaccgcucuccacagcccggacccgggggcuggcccagggcccugcaggcccuggcguccugaugcccccaagcucccucuccugagaagccaccagcaccacccagacuugggggcaggcgccagggacggacgugggccagugcgagcccagagggcccgaaggccggggcccaccauggcccaagcccugcccuggcuccugcuguggaugggcgcgggagugcugccugcccacggcacccagcacggcauccggcugccccugcgcagcggccuggggggcgccccccuggggcugcggcugccccgggagaccgacgaagagcccgaggagcccggccggaggggcagcuuuguggagaugguggacaaccugaggggcaagucggggcagggcuacuacguggagaugaccgugggcagccccccgcagacgcucaacauccugguggauacaggcagcaguaacuuugcagugggugcugccccccaccccuuccugcaucgcuacuaccagaggcagcuguccagcacauaccgggaccuccggaaggguguguaugugcccuacacccagggcaagugggaaggggagcugggcaccgaccugguaagcaucccccauggccccaacgucacugugcgugccaacauugcugccaucacugaaucagacaaguucuucaucaacggcuccaacugggaaggcauccuggggcuggccuaugcugagauugccaggccugacgacucccuggagccuuucuuugacucucugguaaagcagacccacguucccaaccucuucucccugcagcuuuguggugcuggcuucccccucaaccagucugaagugcuggccucugucggagggagcaugaucauuggagguaucgaccacucgcuguacacaggcagucucugguauacacccauccggcgggagugguauuaugaggugaucauugugcggguggagaucaauggacaggaucugaaaauggacugcaaggaguacaacuaugacaagagcauuguggacaguggcaccaccaaccuucguuugcccaagaaaguguuugaagcugcagucaaauccaucaaggcagccuccuccacggagaaguucccugaugguuucuggcuaggagagcagcuggugugcuggcaagcaggcaccaccccuuggaacauuuucccagucaucucacucuaccuaaugggugagguuaccaaccaguccuuccgcaucaccauccuuccgcagcaauaccugcggccaguggaagauguggccacgucccaagacgacuguuacaaguuugccaucucacagucauccacgggcacuguuaugggagcuguuaucauggagggcuucuacguugucuuugaucgggcccgaaaacgaauuggcuuugcugucagcgcuugccaugugcacgaugaguucaggacggcagcgguggaaggcccuuuugucaccuuggacauggaagacuguggcuacaacauuccacagacagaugagucaacccucaugaccauagccuaugucauggcugccaucugcgcccucuucaugcugccacucugccucauggugugucaguggcgcugccuccgcugccugcgccagcagcaugaugacuuugcugaugacaucucccugcugaagugaggaggcccaugggcagaagauagagauuccccuggaccacaccuccgugguucacuuuggucacaaguaggagacacagauggcaccuguggccagagcaccucaggacccuccccacccaccaaaugccucugccuugauggagaaggaaaaggcuggcaagguggguuccagggacuguaccuguaggaaacagaaaagagaagaaagaagcacucugcuggcgggaauacucuuggucaccucaaauuuaagucgggaaauucugcugcuugaaacuucagcccugaaccuuuguccaccauuccuuuaaauucuccaacccaaaguauucuucuuuucuuaguuucagaaguacuggcaucacacgcagguuaccuuggcgugugucccugugguacccuggcagagaagagaccaagcuuguuucccugcuggccaaagucaguaggagaggaugcacaguuugcuauuugcuuuagagacagggacuguauaaacaagccuaacauuggugcaaagauugccucuugaauuaaaaaaaaaaacuagauugacuauuuauacaaaugggggcggcuggaaagaggagaaggagagggaguacaaagacagggaauagugggaucaaagcuaggaaaggcagaaacacaaccacucaccaguccuaguuuuagaccucaucuccaagauagcaucccaucucagaagauggguguuguuuucaauguuuucuuuucugugguugcagccugaccaaaagugagaugggaagggcuuaucuagccaaagagcucuuuuuuagcucucuuaaaugaagugcccacuaagaaguuccacuuaacacaugaauuucugccauauuaauuucauugucucuaucugaaccacccuuuauucuacauaugauaggcagcacugaaauauccuaacccccuaagcuccaggugcccugugggagagcaacuggacuauagcagggcugggcucugucuuccuggucauaggcucacucuuucccccaaaucuuccucuggagcuuugcagccaaggugcuaaaaggaauagguaggagaccucuucuaucuaauccuuaaaagcauaauguugaacauucauucaacagcugaugcccuauaaccccugccuggauuucuuccuauuaggcuauaagaaguagcaagaucuuuacauaauucagagugguuucauugccuuccuacccucucuaauggccccuccauuuauuugacuaaagcaucacacaguggcacuagcauuauaccaagaguaugagaaauacagugcuuuauggcucuaacauuacugccuucaguaucaaggcugccuggagaaaggauggcagccucagggcuuccuuauguccuccaccacaagagcuccuugaugaaggucaucuuuuuccccuauccuguucuuccccuccccgcuccuaaugguacguggguacccaggcugguucuugggcuagguaguggggaccaaguucauuaccucccuaucaguucuagcauaguaaacuacgguaccaguguuagugggaagagcuggguuuuccuaguauacccacugcauccuacuccuaccuggucaacccgcugcuuccagguaugggaccugcuaaguguggaauuaccugauaagggagagggaaauacaaggagggccucugguguuccuggccucagccagcugcccacaagccauaaaccaauaaaacaagaauacugagucaguuuuuuaucuggguucucuucauucccacugcacuuggugcugcuuuggcugacugggaacaccccauaacuacagagucugacaggaagacuggagacuguccacuucuagcucggaacuuacuguguaaauaaacuuucagaacugcuaccaugaagugaaaaugccacauuuugcuuuauaauuucuacccauguugggaaaaacuggcuuuuucccagcccuuuccagggcauaaaacucaaccccuucgauagcaagucccaucagccuauuauuuuuuuaaagaaaacuugcacuuguuuuucuuuuuacaguuacuuccuuccugccccaaaauuauaaacucuaaguguaaaaaaaagucuuaacaacagcuucuugcuuguaaaaauauguauuauacaucuguauuuuuaaauucugcuccugaaaaaugacugucccauucuccacucacugcauuuggggccuuucccauuggucugcaugucuuuuaucauugcaggccaguggacagagggagaagggagaacaggggucgccaacacuuguguugcuuucugacugauccugaacaagaaagaguaacacugaggcgcucgcucccaugcacaacucuccaaaacacuuauccuccugcaagagugggcuuuccagggucuuuacugggaagcaguuaagcccccuccucaccccuuccuuuuuucuuucuuuacuccuuuggcuucaaaggauuuuggaaaagaaacaauaugcuuuacacucauuuucaauuucuaaauuugcaggggauacugaaaaauacggcagguggccuaaggcugcuguaaaguugaggggagaggaaaucuuaagauuacaagauaaaaaacgaauccccuaaacaaaaagaacaauagaacuggucuuccauuuugccaccuuuccuguucaugacagcuacuaaccuggagacaguaacauuucauuaaccaaagaaagugggucaccugaccucugaagagcugaguacucaggccacuccaaucacccuacaagaugccaaggaggucccaggaaguccagcuccuuaaacugacgcuagucaauaaaccugggcaagugaggcaagagaaaugaggaagaauccaucugugaggugacaggcaaggaugaaagacaaagaaggaaaagaguaucaaaggcagaaaggagaucauuuaguugggucugaaaggaaaagucuuugcuauccgacauguacugcuaguaccuguaagcauuuuaggucccagaauggaaaaaaaaaucagcuauugguaauauaauaauguccuuucccuggagucaguuuuuuuaaaaaguuaacucuuaguuuuuacuuguuuaauucuaaaagagaagggagcugaggccauucccuguaggaguaaagauaaaaggauaggaaaagauucaaagcucuaauagagucacagcuuucccagguauaaaaccuaaaauuaagaaguacaauaagcagagguggaaaaugaucuaguuccugauagcuacccacagagcaagugauuuauaaauuugaaauccaaacuacuuucuuaauaucacuuuggucuccauuuuucccaggacaggaaauaugucccccccuaacuuucuugcuucaaaaauuaaaauccagcaucccaagaucauucuacaaguaauuuugcacagacaucuccucaccccagugccugucuggagcucacccaaggucaccaaacaacuugguugugaaccaacugccuuaaccuucugggggagggggauuagcuagacuaggagaccagaagugaaugggaaagggugaggacuucacaauguuggccugucagagcuugauuagaagccaagacaguggcagcaaaggaagacuuggcccaggaaaaaccuguggguugugcuaauuucuguccagaaaauaggguggacagaagcuugugggguacauggaggaauugggaccugguuauguuguuauucucggacugugaauuuuggugauguaaaacagaauauucuguaaaccuaaugucuguauaaauaaugagcguuaacacaguaaaauauucaauaagaagucaaaaaaaaaaaaaaaaaa

SEQ ID NO: 14 - RNA, 5775 nt, Homo_Sapiens
acaagucuuuccgccuccccagcccgcccgggagcugcgagccgcgagcuggauuaugguggccugagcagccaacgcagccgcaggagcccggagcccuugccccugcccgcgccgccgcccgccggggggaccagggaagccgccaccggcccgccaugcccgccccucccagccccgccgggagcccgcgcccgcugcccaggcuggccgccgccgugccgauguagcgggcuccggaucccagccucuccccugcucccgugcucugcggaucuccccugaccgcucuccacagcccggacccgggggcuggcccagggcccugcaggcccuggcguccugaugcccccaagcucccucuccugagaagccaccagcaccacccagacuugggggcaggcgccagggacggacgugggccagugcgagcccagagggcccgaaggccggggcccaccauggcccaagcccugcccuggcuccugcuguggaugggcgcgggagugcugccugcccacggcacccagcacggcauccggcugccccugcgcagcggccuggggggcgccccccuggggcugcggcugccccgggagaccgacgaagagcccgaggagcccggccggaggggcagcuuuguggagaugguggacaaccugaggggcaagucggggcagggcuacuacguggagaugaccgugggcagccccccgcagacgcucaacauccugguggauacaggcagcaguaacuuugcagugggugcugccccccaccccuuccugcaucgcuacuaccagaggcagcuguccagcacauaccgggaccuccggaaggguguguaugugcccuacacccagggcaagugggaaggggagcugggcaccgaccugguaagcaucccccauggccccaacgucacugugcgugccaacauugcugccaucacugaaucagacaaguucuucaucaacggcuccaacugggaaggcauccuggggcuggccuaugcugagauugccaggcuuuguggugcuggcuucccccucaaccagucugaagugcuggccucugucggagggagcaugaucauuggagguaucgaccacucgcuguacacaggcagucucugguauacacccauccggcgggagugguauuaugaggugaucauugugcggguggagaucaauggacaggaucugaaaauggacugcaaggaguacaacuaugacaagagcauuguggacaguggcaccaccaaccuucguuugcccaagaaaguguuugaagcugcagucaaauccaucaaggcagccuccuccacggagaaguucccugaugguuucuggcuaggagagcagcuggugugcuggcaagcaggcaccaccccuuggaacauuuucccagucaucucacucuaccuaaugggugagguuaccaaccaguccuuccgcaucaccauccuuccgcagcaauaccugcggccaguggaagauguggccacgucccaagacgacuguuacaaguuugccaucucacagucauccacgggcacuguuaugggagcuguuaucauggagggcuucuacguugucuuugaucgggcccgaaaacgaauuggcuuugcugucagcgcuugccaugugcacgaugaguucaggacggcagcgguggaaggcccuuuugucaccuuggacauggaagacuguggcuacaacauuccacagacagaugagucaacccucaugaccauagccuaugucauggcugccaucugcgcccucuucaugcugccacucugccucauggugugucaguggcgcugccuccgcugccugcgccagcagcaugaugacuuugcugaugacaucucccugcugaagugaggaggcccaugggcagaagauagagauuccccuggaccacaccuccgugguucacuuuggucacaaguaggagacacagauggcaccuguggccagagcaccucaggacccuccccacccaccaaaugccucugccuugauggagaaggaaaaggcuggcaagguggguuccagggacuguaccuguaggaaacagaaaagagaagaaagaagcacucugcuggcgggaauacucuuggucaccucaaauuuaagucgggaaauucugcugcuugaaacuucagcccugaaccuuuguccaccauuccuuuaaauucuccaacccaaaguauucuucuuuucuuaguuucagaaguacuggcaucacacgcagguuaccuuggcgugugucccugugguacccuggcagagaagagaccaagcuuguuucccugcuggccaaagucaguaggagaggaugcacaguuugcuauuugcuuuagagacagggacuguauaaacaagccuaacauuggugcaaagauugccucuugaauuaaaaaaaaaaacuagauugacuauuuauacaaaugggggcggcuggaaagaggagaaggagagggaguacaaagacagggaauagugggaucaaagcuaggaaaggcagaaacacaaccacucaccaguccuaguuuuagaccucaucuccaagauagcaucccaucucagaagauggguguuguuuucaauguuuucuuuucugugguugcagccugaccaaaagugagaugggaagggcuuaucuagccaaagagcucuuuuuuagcucucuuaaaugaagugcccacuaagaaguuccacuuaacacaugaauuucugccauauuaauuucauugucucuaucugaaccacccuuuauucuacauaugauaggcagcacugaaauauccuaacccccuaagcuccaggugcccugugggagagcaacuggacuauagcagggcugggcucugucuuccuggucauaggcucacucuuucccccaaaucuuccucuggagcuuugcagccaaggugcuaaaaggaauagguaggagaccucuucuaucuaauccuuaaaagcauaauguugaacauucauucaacagcugaugcccuauaaccccugccuggauuucuuccuauuaggcuauaagaaguagcaagaucuuuacauaauucagagugguuucauugccuuccuacccucucuaauggccccuccauuuauuugacuaaagcaucacacaguggcacuagcauuauaccaagaguaugagaaauacagugcuuuauggcucuaacauuacugccuucaguaucaaggcugccuggagaaaggauggcagccucagggcuuccuuauguccuccaccacaagagcuccuugaugaaggucaucuuuuuccccuauccuguucuuccccuccccgcuccuaaugguacguggguacccaggcugguucuugggcuagguaguggggaccaaguucauuaccucccuaucaguucuagcauaguaaacuacgguaccaguguuagugggaagagcuggguuuuccuaguauacccacugcauccuacuccuaccuggucaacccgcugcuuccagguaugggaccugcuaaguguggaauuaccugauaagggagagggaaauacaaggagggccucugguguuccuggccucagccagcugcccacaagccauaaaccaauaaaacaagaauacugagucaguuuuuuaucuggguucucuucauucccacugcacuuggugcugcuuuggcugacugggaacaccccauaacuacagagucugacaggaagacuggagacuguccacuucuagcucggaacuuacuguguaaauaaacuuucagaacugcuaccaugaagugaaaaugccacauuuugcuuuauaauuucuacccauguugggaaaaacuggcuuuuucccagcccuuuccagggcauaaaacucaaccccuucgauagcaagucccaucagccuauuauuuuuuuaaagaaaacuugcacuuguuuuucuuuuuacaguuacuuccuuccugccccaaaauuauaaacucuaaguguaaaaaaaagucuuaacaacagcuucuugcuuguaaaaauauguauuauacaucuguauuuuuaaauucugcuccugaaaaaugacugucccauucuccacucacugcauuuggggccuuucccauuggucugcaugucuuuuaucauugcaggccaguggacagagggagaagggagaacaggggucgccaacacuuguguugcuuucugacugauccugaacaagaaagaguaacacugaggcgcucgcucccaugcacaacucuccaaaacacuuauccuccugcaagagugggcuuuccagggucuuuacugggaagcaguuaagcccccuccucaccccuuccuuuuuucuuucuuuacuccuuuggcuucaaaggauuuuggaaaagaaacaauaugcuuuacacucauuuucaauuucuaaauuugcaggggauacugaaaaauacggcagguggccuaaggcugcuguaaaguugaggggagaggaaaucuuaagauuacaagauaaaaaacgaauccccuaaacaaaaagaacaauagaacuggucuuccauuuugccaccuuuccuguucaugacagcuacuaaccuggagacaguaacauuucauuaaccaaagaaagugggucaccugaccucugaagagcugaguacucaggccacuccaaucacccuacaagaugccaaggaggucccaggaaguccagcuccuuaaacugacgcuagucaauaaaccugggcaagugaggcaagagaaaugaggaagaauccaucugugaggugacaggcaaggaugaaagacaaagaaggaaaagaguaucaaaggcagaaaggagaucauuuaguugggucugaaaggaaaagucuuugcuauccgacauguacugcuaguaccuguaagcauuuuaggucccagaauggaaaaaaaaaucagcuauugguaauauaauaauguccuuucccuggagucaguuuuuuuaaaaaguuaacucuuaguuuuuacuuguuuaauucuaaaagagaagggagcugaggccauucccuguaggaguaaagauaaaaggauaggaaaagauucaaagcucuaauagagucacagcuuucccagguauaaaaccuaaaauuaagaaguacaauaagcagagguggaaaaugaucuaguuccugauagcuacccacagagcaagugauuuauaaauuugaaauccaaacuacuuucuuaauaucacuuuggucuccauuuuucccaggacaggaaauaugucccccccuaacuuucuugcuucaaaaauuaaaauccagcaucccaagaucauucuacaaguaauuuugcacagacaucuccucaccccagugccugucuggagcucacccaaggucaccaaacaacuugguugugaaccaacugccuuaaccuucugggggagggggauuagcuagacuaggagaccagaagugaaugggaaagggugaggacuucacaauguuggccugucagagcuugauuagaagccaagacaguggcagcaaaggaagacuuggcccaggaaaaaccuguggguugugcuaauuucuguccagaaaauaggguggacagaagcuugugggguacauggaggaauugggaccugguuauguuguuauucucggacugugaauuuuggugauguaaaacagaauauucuguaaaccuaaugucuguauaaauaaugagcguuaacacaguaaaauauucaauaagaagucaaaaaaaaaaaaaaaaaa

SEQ ID NO: 15 - RNA, 5718 nt, Homo_Sapiens
acaagucuuuccgccuccccagcccgcccgggagcugcgagccgcgagcuggauuaugguggccugagcagccaacgcagccgcaggagcccggagcccuugccccugcccgcgccgccgcccgccggggggaccagggaagccgccaccggcccgccaugcccgccccucccagccccgccgggagcccgcgcccgcugcccaggcuggccgccgccgugccgauguagcgggcuccggaucccagccucuccccugcucccgugcucugcggaucuccccugaccgcucuccacagcccggacccgggggcuggcccagggcccugcaggcccuggcguccugaugcccccaagcucccucuccugagaagccaccagcaccacccagacuugggggcaggcgccagggacggacgugggccagugcgagcccagagggcccgaaggccggggcccaccauggcccaagcccugcccuggcuccugcuguggaugggcgcgggagugcugccugcccacggcacccagcacggcauccggcugccccugcgcagcggccuggggggcgccccccuggggcugcggcugccccgggagaccgacgaagagcccgaggagcccggccggaggggcagcuuuguggagaugguggacaaccugaggggcaagucggggcagggcuacuacguggagaugaccgugggcagccccccgcagacgcucaacauccugguggauacaggcagcaguaacuuugcagugggugcugccccccaccccuuccugcaucgcuacuaccagaggcagcuguccagcacauaccgggaccuccggaaggguguguaugugcccuacacccagggcaagugggaaggggagcugggcaccgaccugccugacgacucccuggagccuuucuuugacucucugguaaagcagacccacguucccaaccucuucucccugcagcuuuguggugcuggcuucccccucaaccagucugaagugcuggccucugucggagggagcaugaucauuggagguaucgaccacucgcuguacacaggcagucucugguauacacccauccggcgggagugguauuaugaggugaucauugugcggguggagaucaauggacaggaucugaaaauggacugcaaggaguacaacuaugacaagagcauuguggacaguggcaccaccaaccuucguuugcccaagaaaguguuugaagcugcagucaaauccaucaaggcagccuccuccacggagaaguucccugaugguuucuggcuaggagagcagcuggugugcuggcaagcaggcaccaccccuuggaacauuuucccagucaucucacucuaccuaaugggugagguuaccaaccaguccuuccgcaucaccauccuuccgcagcaauaccugcggccaguggaagauguggccacgucccaagacgacuguuacaaguuugccaucucacagucauccacgggcacuguuaugggagcuguuaucauggagggcuucuacguugucuuugaucgggcccgaaaacgaauuggcuuugcugucagcgcuugccaugugcacgaugaguucaggacggcagcgguggaaggcccuuuugucaccuuggacauggaagacuguggcuacaacauuccacagacagaugagucaacccucaugaccauagccuaugucauggcugccaucugcgcccucuucaugcugccacucugccucauggugugucaguggcgcugccuccgcugccugcgccagcagcaugaugacuuugcugaugacaucucccugcugaagugaggaggcccaugggcagaagauagagauuccccuggaccacaccuccgugguucacuuuggucacaaguaggagacacagauggcaccuguggccagagcaccucaggacccuccccacccaccaaaugccucugccuugauggagaaggaaaaggcuggcaagguggguuccagggacuguaccuguaggaaacagaaaagagaagaaagaagcacucugcuggcgggaauacucuuggucaccucaaauuuaagucgggaaauucugcugcuugaaacuucagcccugaaccuuuguccaccauuccuuuaaauucuccaacccaaaguauucuucuuuucuuaguuucagaaguacuggcaucacacgcagguuaccuuggcgugugucccugugguacccuggcagagaagagaccaagcuuguuucccugcuggccaaagucaguaggagaggaugcacaguuugcuauuugcuuuagagacagggacuguauaaacaagccuaacauuggugcaaagauugccucuugaauuaaaaaaaaaaacuagauugacuauuuauacaaaugggggcggcuggaaagaggagaaggagagggaguacaaagacagggaauagugggaucaaagcuaggaaaggcagaaacacaaccacucaccaguccuaguuuuagaccucaucuccaagauagcaucccaucucagaagauggguguuguuuucaauguuuucuuuucugugguugcagccugaccaaaagugagaugggaagggcuuaucuagccaaagagcucuuuuuuagcucucuuaaaugaagugcccacuaagaaguuccacuuaacacaugaauuucugccauauuaauuucauugucucuaucugaaccacccuuuauucuacauaugauaggcagcacugaaauauccuaacccccuaagcuccaggugcccugugggagagcaacuggacuauagcagggcugggcucugucuuccuggucauaggcucacucuuucccccaaaucuuccucuggagcuuugcagccaaggugcuaaaaggaauagguaggagaccucuucuaucuaauccuuaaaagcauaauguugaacauucauucaacagcugaugcccuauaaccccugccuggauuucuuccuauuaggcuauaagaaguagcaagaucuuuacauaauucagagugguuucauugccuuccuacccucucuaauggccccuccauuuauuugacuaaagcaucacacaguggcacuagcauuauaccaagaguaugagaaauacagugcuuuauggcucuaacauuacugccuucaguaucaaggcugccuggagaaaggauggcagccucagggcuuccuuauguccuccaccacaagagcuccuugaugaaggucaucuuuuuccccuauccuguucuuccccuccccgcuccuaaugguacguggguacccaggcugguucuugggcuagguaguggggaccaaguucauuaccucccuaucaguucuagcauaguaaacuacgguaccaguguuagugggaagagcuggguuuuccuaguauacccacugcauccuacuccuaccuggucaacccgcugcuuccagguaugggaccugcuaaguguggaauuaccugauaagggagagggaaauacaaggagggccucugguguuccuggccucagccagcugcccacaagccauaaaccaauaaaacaagaauacugagucaguuuuuuaucuggguucucuucauucccacugcacuuggugcugcuuuggcugacugggaacaccccauaacuacagagucugacaggaagacuggagacuguccacuucuagcucggaacuuacuguguaaauaaacuuucagaacugcuaccaugaagugaaaaugccacauuuugcuuuauaauuucuacccauguugggaaaaacuggcuuuuucccagcccuuuccagggcauaaaacucaaccccuucgauagcaagucccaucagccuauuauuuuuuuaaagaaaacuugcacuuguuuuucuuuuuacaguuacuuccuuccugccccaaaauuauaaacucuaaguguaaaaaaaagucuuaacaacagcuucuugcuuguaaaaauauguauuauacaucuguauuuuuaaauucugcuccugaaaaaugacugucccauucuccacucacugcauuuggggccuuucccauuggucugcaugucuuuuaucauugcaggccaguggacagagggagaagggagaacaggggucgccaacacuuguguugcuuucugacugauccugaacaagaaagaguaacacugaggcgcucgcucccaugcacaacucuccaaaacacuuauccuccugcaagagugggcuuuccagggucuuuacugggaagcaguuaagcccccuccucaccccuuccuuuuuucuuucuuuacuccuuuggcuucaaaggauuuuggaaaagaaacaauaugcuuuacacucauuuucaauuucuaaauuugcaggggauacugaaaaauacggcagguggccuaaggcugcuguaaaguugaggggagaggaaaucuuaagauuacaagauaaaaaacgaauccccuaaacaaaaagaacaauagaacuggucuuccauuuugccaccuuuccuguucaugacagcuacuaaccuggagacaguaacauuucauuaaccaaagaaagugggucaccugaccucugaagagcugaguacucaggccacuccaaucacccuacaagaugccaaggaggucccaggaaguccagcuccuuaaacugacgcuagucaauaaaccugggcaagugaggcaagagaaaugaggaagaauccaucugugaggugacaggcaaggaugaaagacaaagaaggaaaagaguaucaaaggcagaaaggagaucauuuaguugggucugaaaggaaaagucuuugcuauccgacauguacugcuaguaccuguaagcauuuuaggucccagaauggaaaaaaaaaucagcuauugguaauauaauaauguccuuucccuggagucaguuuuuuuaaaaaguuaacucuuaguuuuuacuuguuuaauucuaaaagagaagggagcugaggccauucccuguaggaguaaagauaaaaggauaggaaaagauucaaagcucuaauagagucacagcuuucccagguauaaaaccuaaaauuaagaaguacaauaagcagagguggaaaaugaucuaguuccugauagcuacccacagagcaagugauuuauaaauuugaaauccaaacuacuuucuuaauaucacuuuggucuccauuuuucccaggacaggaaauaugucccccccuaacuuucuugcuucaaaaauuaaaauccagcaucccaagaucauucuacaaguaauuuugcacagacaucuccucaccccagugccugucuggagcucacccaaggucaccaaacaacuugguugugaaccaacugccuuaaccuucugggggagggggauuagcuagacuaggagaccagaagugaaugggaaagggugaggacuucacaauguuggccugucagagcuugauuagaagccaagacaguggcagcaaaggaagacuuggcccaggaaaaaccuguggguugugcuaauuucuguccagaaaauaggguggacagaagcuugugggguacauggaggaauugggaccugguuauguuguuauucucggacugugaauuuuggugauguaaaacagaauauucuguaaaccuaaugucuguauaaauaaugagcguuaacacaguaaaauauucaauaagaagucaaaaaaaaaaaaaaaaaa

SEQ ID NO: 16 - RNA, 5643 nt, Homo_Sapiens
acaagucuuuccgccuccccagcccgcccgggagcugcgagccgcgagcuggauuaugguggccugagcagccaacgcagccgcaggagcccggagcccuugccccugcccgcgccgccgcccgccggggggaccagggaagccgccaccggcccgccaugcccgccccucccagccccgccgggagcccgcgcccgcugcccaggcuggccgccgccgugccgauguagcgggcuccggaucccagccucuccccugcucccgugcucugcggaucuccccugaccgcucuccacagcccggacccgggggcuggcccagggcccugcaggcccuggcguccugaugcccccaagcucccucuccugagaagccaccagcaccacccagacuugggggcaggcgccagggacggacgugggccagugcgagcccagagggcccgaaggccggggcccaccauggcccaagcccugcccuggcuccugcuguggaugggcgcgggagugcugccugcccacggcacccagcacggcauccggcugccccugcgcagcggccuggggggcgccccccuggggcugcggcugccccgggagaccgacgaagagcccgaggagcccggccggaggggcagcuuuguggagaugguggacaaccugaggggcaagucggggcagggcuacuacguggagaugaccgugggcagccccccgcagacgcucaacauccugguggauacaggcagcaguaacuuugcagugggugcugccccccaccccuuccugcaucgcuacuaccagaggcagcuguccagcacauaccgggaccuccggaaggguguguaugugcccuacacccagggcaagugggaaggggagcugggcaccgaccugcuuuguggugcuggcuucccccucaaccagucugaagugcuggccucugucggagggagcaugaucauuggagguaucgaccacucgcuguacacaggcagucucugguauacacccauccggcgggagugguauuaugaggugaucauugugcggguggagaucaauggacaggaucugaaaauggacugcaaggaguacaacuaugacaagagcauuguggacaguggcaccaccaaccuucguuugcccaagaaaguguuugaagcugcagucaaauccaucaaggcagccuccuccacggagaaguucccugaugguuucuggcuaggagagcagcuggugugcuggcaagcaggcaccaccccuuggaacauuuucccagucaucucacucuaccuaaugggugagguuaccaaccaguccuuccgcaucaccauccuuccgcagcaauaccugcggccaguggaagauguggccacgucccaagacgacuguuacaaguuugccaucucacagucauccacgggcacuguuaugggagcuguuaucauggagggcuucuacguugucuuugaucgggcccgaaaacgaauuggcuuugcugucagcgcuugccaugugcacgaugaguucaggacggcagcgguggaaggcccuuuugucaccuuggacauggaagacuguggcuacaacauuccacagacagaugagucaacccucaugaccauagccuaugucauggcugccaucugcgcccucuucaugcugccacucugccucauggugugucaguggcgcugccuccgcugccugcgccagcagcaugaugacuuugcugaugacaucucccugcugaagugaggaggcccaugggcagaagauagagauuccccuggaccacaccuccgugguucacuuuggucacaaguaggagacacagauggcaccuguggccagagcaccucaggacccuccccacccaccaaaugccucugccuugauggagaaggaaaaggcuggcaagguggguuccagggacuguaccuguaggaaacagaaaagagaagaaagaagcacucugcuggcgggaauacucuuggucaccucaaauuuaagucgggaaauucugcugcuugaaacuucagcccugaaccuuuguccaccauuccuuuaaauucuccaacccaaaguauucuucuuuucuuaguuucagaaguacuggcaucacacgcagguuaccuuggcgugugucccugugguacccuggcagagaagagaccaagcuuguuucccugcuggccaaagucaguaggagaggaugcacaguuugcuauuugcuuuagagacagggacuguauaaacaagccuaacauuggugcaaagauugccucuugaauuaaaaaaaaaaacuagauugacuauuuauacaaaugggggcggcuggaaagaggagaaggagagggaguacaaagacagggaauagugggaucaaagcuaggaaaggcagaaacacaaccacucaccaguccuaguuuuagaccucaucuccaagauagcaucccaucucagaagauggguguuguuuucaauguuuucuuuucugugguugcagccugaccaaaagugagaugggaagggcuuaucuagccaaagagcucuuuuuuagcucucuuaaaugaagugcccacuaagaaguuccacuuaacacaugaauuucugccauauuaauuucauugucucuaucugaaccacccuuuauucuacauaugauaggcagcacugaaauauccuaacccccuaagcuccaggugcccugugggagagcaacuggacuauagcagggcugggcucugucuuccuggucauaggcucacucuuucccccaaaucuuccucuggagcuuugcagccaaggugcuaaaaggaauagguaggagaccucuucuaucuaauccuuaaaagcauaauguugaacauucauucaacagcugaugcccuauaaccccugccuggauuucuuccuauuaggcuauaagaaguagcaagaucuuuacauaauucagagugguuucauugccuuccuacccucucuaauggccccuccauuuauuugacuaaagcaucacacaguggcacuagcauuauaccaagaguaugagaaauacagugcuuuauggcucuaacauuacugccuucaguaucaaggcugccuggagaaaggauggcagccucagggcuuccuuauguccuccaccacaagagcuccuugaugaaggucaucuuuuuccccuauccuguucuuccccuccccgcuccuaaugguacguggguacccaggcugguucuugggcuagguaguggggaccaaguucauuaccucccuaucaguucuagcauaguaaacuacgguaccaguguuagugggaagagcuggguuuuccuaguauacccacugcauccuacuccuaccuggucaacccgcugcuuccagguaugggaccugcuaaguguggaauuaccugauaagggagagggaaauacaaggagggccucugguguuccuggccucagccagcugcccacaagccauaaaccaauaaaacaagaauacugagucaguuuuuuaucuggguucucuucauucccacugcacuuggugcugcuuuggcugacugggaacaccccauaacuacagagucugacaggaagacuggagacuguccacuucuagcucggaacuuacuguguaaauaaacuuucagaacugcuaccaugaagugaaaaugccacauuuugcuuuauaauuucuacccauguugggaaaaacuggcuuuuucccagcccuuuccagggcauaaaacucaaccccuucgauagcaagucccaucagccuauuauuuuuuuaaagaaaacuugcacuuguuuuucuuuuuacaguuacuuccuuccugccccaaaauuauaaacucuaaguguaaaaaaaagucuuaacaacagcuucuugcuuguaaaaauauguauuauacaucuguauuuuuaaauucugcuccugaaaaaugacugucccauucuccacucacugcauuuggggccuuucccauuggucugcaugucuuuuaucauugcaggccaguggacagagggagaagggagaacaggggucgccaacacuuguguugcuuucugacugauccugaacaagaaagaguaacacugaggcgcucgcucccaugcacaacucuccaaaacacuuauccuccugcaagagugggcuuuccagggucuuuacugggaagcaguuaagcccccuccucaccccuuccuuuuuucuuucuuuacuccuuuggcuucaaaggauuuuggaaaagaaacaauaugcuuuacacucauuuucaauuucuaaauuugcaggggauacugaaaaauacggcagguggccuaaggcugcuguaaaguugaggggagaggaaaucuuaagauuacaagauaaaaaacgaauccccuaaacaaaaagaacaauagaacuggucuuccauuuugccaccuuuccuguucaugacagcuacuaaccuggagacaguaacauuucauuaaccaaagaaagugggucaccugaccucugaagagcugaguacucaggccacuccaaucacccuacaagaugccaaggaggucccaggaaguccagcuccuuaaacugacgcuagucaauaaaccugggcaagugaggcaagagaaaugaggaagaauccaucugugaggugacaggcaaggaugaaagacaaagaaggaaaagaguaucaaaggcagaaaggagaucauuuaguugggucugaaaggaaaagucuuugcuauccgacauguacugcuaguaccuguaagcauuuuaggucccagaauggaaaaaaaaaucagcuauugguaauauaauaauguccuuucccuggagucaguuuuuuuaaaaaguuaacucuuaguuuuuacuuguuuaauucuaaaagagaagggagcugaggccauucccuguaggaguaaagauaaaaggauaggaaaagauucaaagcucuaauagagucacagcuuucccagguauaaaaccuaaaauuaagaaguacaauaagcagagguggaaaaugaucuaguuccugauagcuacccacagagcaagugauuuauaaauuugaaauccaaacuacuuucuuaauaucacuuuggucuccauuuuucccaggacaggaaauaugucccccccuaacuuucuugcuucaaaaauuaaaauccagcaucccaagaucauucuacaaguaauuuugcacagacaucuccucaccccagugccugucuggagcucacccaaggucaccaaacaacuugguugugaaccaacugccuuaaccuucugggggagggggauuagcuagacuaggagaccagaagugaaugggaaagggugaggacuucacaauguuggccugucagagcuugauuagaagccaagacaguggcagcaaaggaagacuuggcccaggaaaaaccuguggguugugcuaauuucuguccagaaaauaggguggacagaagcuugugggguacauggaggaauugggaccugguuauguuguuauucucggacugugaauuuuggugauguaaaacagaauauucuguaaaccuaaugucuguauaaauaaugagcguuaacacaguaaaauauucaauaagaagucaaaaaaaaaaaaaaaaaa

SEQ ID NO: 17 - RNA, 1364 nt, Homo_Sapiens
gggaggagagaaaagccauggccgacaagguccugaaggagaagagaaagcuguuuauccguuccaugggugaagguacaauaaauggcuuacuggaugaauuauuacagacaagggugcugaacaaggaagagauggagaaaguaaaacgugaaaaugcuacaguuauggauaagacccgagcuuugauugacuccguuauuccgaaaggggcacaggcaugccaaauuugcaucacauacauuugugaagaagacaguuaccuggcagggacgcugggacucucagcagaucaaacaucuggaaauuaccuuaauaugcaagacucucaaggaguacuuucuuccuuuccagcuccucaggcagugcaggacaacccagcuaugcccacauccucaggcucagaagggaaugucaagcuuugcucccuagaagaagcucaaaggauauggaaacaaaagucggcagagauuuauccaauaauggacaagucaagccgcacacgucuugcucucauuaucugcaaugaagaauuugacaguauuccuagaagaacuggagcugagguugacaucacaggcaugacaaugcugcuacaaaaucugggguacagcguagaugugaaaaaaaaucucacugcuucggacaugacuacagagcuggaggcauuugcacaccgcccagagcacaagaccucugacagcacguuccugguguucaugucucaugguauucgggaaggcauuugugggaagaaacacucugagcaagucccagauauacuacaacucaaugcaaucuuuaacauguugaauaccaagaacugcccaaguuugaaggacaaaccgaaggugaucaucauccaggccugccguggugacagcccugguguggugugguuuaaagauucaguaggaguuucuggaaaccuaucuuuaccaacuacagaagaguuugaggaugaugcuauuaagaaagcccacauagagaaggauuuuaucgcuuucugcucuuccacaccagauaauguuucuuggagacaucccacaaugggcucuguuuuuauuggaagacucauugaacauaugcaagaauaugccuguuccugugauguggaggaaauuuuccgcaagguucgauuuucauuugagcagccagaugguagagcgcagaugcccaccacugaaagagugacuuugacaagauguuucuaccucuucccaggacauuaaaauaaggaaacuguaugaaugucugugggcaggaagugaagagauccuucuguaaagguuuuuggaauuaugucugcugaauaauaaacuuuuuugaaauaauaaaucugguagaaaaaugaaaaaaaaaaa

SEQ ID NO: 18 - RNA, 1301 nt, Homo_Sapiens
gggaggagagaaaagccauggccgacaagguccugaaggagaagagaaagcuguuuauccguuccaugggugaagguacaauaaauggcuuacuggaugaauuauuacagacaagggugcugaacaaggaagagauggagaaaguaaaacgugaaaaugcuacaguuauggauaagacccgagcuuugauugacuccguuauuccgaaaggggcacaggcaugccaaauuugcaucacauacauuugugaagaagacaguuaccuggcagggacgcugggacucucagcagcuccucaggcagugcaggacaacccagcuaugcccacauccucaggcucagaagggaaugucaagcuuugcucccuagaagaagcucaaaggauauggaaacaaaagucggcagagauuuauccaauaauggacaagucaagccgcacacgucuugcucucauuaucugcaaugaagaauuugacaguauuccuagaagaacuggagcugagguugacaucacaggcaugacaaugcugcuacaaaaucugggguacagcguagaugugaaaaaaaaucucacugcuucggacaugacuacagagcuggaggcauuugcacaccgcccagagcacaagaccucugacagcacguuccugguguucaugucucaugguauucgggaaggcauuugugggaagaaacacucugagcaagucccagauauacuacaacucaaugcaaucuuuaacauguugaauaccaagaacugcccaaguuugaaggacaaaccgaaggugaucaucauccaggccugccguggugacagcccugguguggugugguuuaaagauucaguaggaguuucuggaaaccuaucuuuaccaacuacagaagaguuugaggaugaugcuauuaagaaagcccacauagagaaggauuuuaucgcuuucugcucuuccacaccagauaauguuucuuggagacaucccacaaugggcucuguuuuuauuggaagacucauugaacauaugcaagaauaugccuguuccugugauguggaggaaauuuuccgcaagguucgauuuucauuugagcagccagaugguagagcgcagaugcccaccacugaaagagugacuuugacaagauguuucuaccucuucccaggacauuaaaauaaggaaacuguaugaaugucugugggcaggaagugaagagauccuucuguaaagguuuuuggaauuaugucugcugaauaauaaacuuuuuugaaauaauaaaucugguagaaaaaugaaaaaaaaaaa

SEQ ID NO: 19 - RNA, 1085 nt, Homo_Sapiens
gggaggagagaaaagccauggccgacaagguccugaaggagaagagaaagcuguuuauccguuccaugggugaagcuccucaggcagugcaggacaacccagcuaugcccacauccucaggcucagaagggaaugucaagcuuugcucccuagaagaagcucaaaggauauggaaacaaaagucggcagagauuuauccaauaauggacaagucaagccgcacacgucuugcucucauuaucugcaaugaagaauuugacaguauuccuagaagaacuggagcugagguugacaucacaggcaugacaaugcugcuacaaaaucugggguacagcguagaugugaaaaaaaaucucacugcuucggacaugacuacagagcuggaggcauuugcacaccgcccagagcacaagaccucugacagcacguuccugguguucaugucucaugguauucgggaaggcauuugugggaagaaacacucugagcaagucccagauauacuacaacucaaugcaaucuuuaacauguugaauaccaagaacugcccaaguuugaaggacaaaccgaaggugaucaucauccaggccugccguggugacagcccugguguggugugguuuaaagauucaguaggaguuucuggaaaccuaucuuuaccaacuacagaagaguuugaggaugaugcuauuaagaaagcccacauagagaaggauuuuaucgcuuucugcucuuccacaccagauaauguuucuuggagacaucccacaaugggcucuguuuuuauuggaagacucauugaacauaugcaagaauaugccuguuccugugauguggaggaaauuuuccgcaagguucgauuuucauuugagcagccagaugguagagcgcagaugcccaccacugaaagagugacuuugacaagauguuucuaccucuucccaggacauuaaaauaaggaaacuguaugaaugucugugggcaggaagugaagagauccuucuguaaagguuuuuggaauuaugucugcugaauaauaaacuuuuuugaaauaauaaaucugguagaaaaaugaaaaaaaaaaa

SEQ ID NO: 20 - RNA, 941 nt, Homo_Sapiens
gggaggagagaaaagccauggccgacaagguccugaaggagaagagaaagcuguuuauccguuccaugggugaagcuccucaggcagugcaggacaacccagcuaugcccacauccucaggcucagaagggaaugucaagcuuugcucccuagaagaagcucaaaggauauggaaacaaaagucggcagagauuuauccaauaauggacaagucaagccgcacacgucuugcucucauuaucugcaaugaagaauuugacaguauuccuagaagaacuggagcugagguugacaucacaggcaugacaaugcugcuacaaaaucugggguacagcguagaugugaaaaaaaaucucacugcuucggacaugacuacagagcuggaggcauuugcacaccgcccagagcacaagaccucugacagcacguuccugguguucaugucucaugguauucgggaaggcauuugugggaagaaacacucugagcaagucccagauauacuacaacucaaugcaaucuuuaacauguugaauaccaagaacugcccaaguuugaaggacaaaccgaaggugaucaucauccaggccugccguggugauaauguuucuuggagacaucccacaaugggcucuguuuuuauuggaagacucauugaacauaugcaagaauaugccuguuccugugauguggaggaaauuuuccgcaagguucgauuuucauuugagcagccagaugguagagcgcagaugcccaccacugaaagagugacuuugacaagauguuucuaccucuucccaggacauuaaaauaaggaaacuguaugaaugucugugggcaggaagugaagagauccuucuguaaagguuuuuggaauuaugucugcugaauaauaaacuuuuuugaaauaauaaaucugguagaaaaaugaaaaaaaaaaa

SEQ ID NO: 21 - RNA, 416 nt, Homo_Sapiens
gggaggagagaaaagccauggccgacaagguccugaaggagaagagaaagcuguuuauccguuccaugggugaagauaauguuucuuggagacaucccacaaugggcucuguuuuuauuggaagacucauugaacauaugcaagaauaugccuguuccugugauguggaggaaauuuuccgcaagguucgauuuucauuugagcagccagaugguagagcgcagaugcccaccacugaaagagugacuuugacaagauguuucuaccucuucccaggacauuaaaauaaggaaacuguaugaaugucugugggcaggaagugaagagauccuucuguaaagguuuuuggaauuaugucugcugaauaauaaacuuuuuugaaauaauaaaucugguagaaaaaugaaaaaaaaaaa

SEQ ID NO: 22 - RNA, 4145 nt, Homo_Sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagcacugagggagaccaagcaaggccaccuggaggauauguugcucaccacccuuucugggcuucagcauguacucccaccguugagcugugacuacgacuugagucucccuuuuccggugugugaguccuguccccuuuacaagaagcuccgccugucgacagauacuguggaacacucccuagacaauaaagaugguccugucugccuucaggugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 23 - RNA, 3927 nt, Homo_Sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 24 - RNA, 2689 nt, Homo_Sapiens
acaucucccggcggcgggccgcggaagcagugcagacgcggcuccuagcggaugggugcuauugugaggcgguuguagaagaguuucgugagugcucgcagcucauaccuguggcuguguauccguggccacagcugguuggcgucgccuugaaaucccaggccgugaggaguuagcgagcccugcucacacucggcgcucugguuuucggugggugugcccugcaccugccucuucccccauucucauuaauaaagguauccauggagaacacugaaaacucaguggauucaaaauccauuaaaaauuuggaaccaaagaucauacauggaagcgaaucaauggacucuggaauaucccuggacaacaguuauaaaauggauuauccugagauggguuuauguauaauaauuaauaauaagaauuuucauaaaagcacuggaaugacaucucggucugguacagaugucgaugcagcaaaccucagggaaacauucagaaacuugaaauaugaagucaggaauaaaaaugaucuuacacgugaagaaauuguggaauugaugcgugauguuucuaaagaagaucacagcaaaaggagcaguuuuguuugugugcuucugagccauggugaagaaggaauaauuuuuggaacaaauggaccuguugaccugaaaaaaauaacaaacuuuuucagaggggaucguuguagaagucuaacuggaaaacccaaacuuuucauuauucaggccugccgugguacagaacuggacuguggcauugagacagacagugguguugaugaugacauggcgugucauaaaauaccaguggaggccgacuucuuguaugcauacuccacagcaccugguuauuauucuuggcgaaauucaaaggauggcuccugguucauccagucgcuuugugccaugcugaaacaguaugccgacaagcuugaauuuaugcacauucuuacccggguuaaccgaaagguggcaacagaauuugaguccuuuuccuuugacgcuacuuuucaugcaaagaaacagauuccauguauuguuuccaugcucacaaaagaacucuauuuuuaucacuaaagaaaugguugguuggugguuuuuuuuaguuuguaugccaagugagaagaugguauauuugguacuguauuucccucucauuuugaccuacucucaugcugcagaggguacuuuaagacauacuccuuccaucaaauagaaccacuaugaagcuaccucaaacuuccagucagguaguugcaauugaauuaaauuaggaauaaauaaaaauggauacuggugcagucauuaugagaggcaaugauuguuaauuuacagcuuucaugauuagcaaguuacagugaugcugugcuaugaauuuucaaguaauugugaaaaaguuaaacauugaaguaaugaauuuuuaugauauuccccccacuuaagacuguguauucuaguuuugucaaacuguagaaaugaugauguggaagaacuuaggcaucugugggcauggucaaaggcucaaaccuuuauuuuagaauugauauacacggaugacuuaacugcauuuuuagaccauuuaucugggauuaugguuuugugauguuuguccugaacacuuuuguuguaaaaaaauaauaauaauguuuaauauugagaaagaaacuaauauuuuaugugagagaaagugugagcaaacuaacuugacuuuuaaggcuaaaacuuaacauucauagagggguggaguuuuaacuguaaggugcuacaaugccccuggaucuaccagcauaaauaucuucugauuugucccuaugcauaucaguugagcuucauauaccagcaauauaucugaagagcuauuauauaaaaaccccaaacuguugauuauuagccagguaaugugaauaaauucuauaggaacauaugaaaauacaacuuaaauaauaaacaguggaauauaaggaaagcaauaaaugaaugggcugagcugccuguaacuugagaguagaugguuugagccugagcagagacaugacucagccuguuccaugaaggcagagccauggaccacgcaggaagggccuacagcccauuucuccauacgcacugguauguguggaugaugcugccagggcgccaucgccaaguaagaaagugaagcaaaucagaaacuugugaaguggaaauguucuaaagguggugaggcaauaaaaaucauaguacucuuuguagcaaaauucuuaaguauguuauuuucuguugaaguuuacaaucaaaggaaaauaguaauguuuuauacuguuuacugaaagaaaaagaccuaugagcacauaggacucuagacggcauccagccggaggccagagcugagcccucagcccgggaggcaggcuccaggccucagcaggugcggagccgucacugcaccaagucucacuggcugucaguaugacauuucacgggagauuucuuguugcucaaaaaaugagcucgcauuugucaaugacaguuucuuuuuucuuacuagaccuguaacuuuuguaaauacacauagcauguaaugguaucuuaaaguguguuucuaugugacaauuuuguacaaauuuguuauuuuccauuuuuauuucaaaauauacauucaaacuuaaaauuaaaaaaaaaaaaaaaaa

SEQ ID NO: 25 - RNA, 2522 nt, Homo_Sapiens
acaucucccggcggcgggccgcggaagcagugcagacgcggcuccuagcggaugggugcuauugugaggcgguuguagaaguuaauaaagguauccauggagaacacugaaaacucaguggauucaaaauccauuaaaaauuuggaaccaaagaucauacauggaagcgaaucaauggacucuggaauaucccuggacaacaguuauaaaauggauuauccugagauggguuuauguauaauaauuaauaauaagaauuuucauaaaagcacuggaaugacaucucggucugguacagaugucgaugcagcaaaccucagggaaacauucagaaacuugaaauaugaagucaggaauaaaaaugaucuuacacgugaagaaauuguggaauugaugcgugauguuucuaaagaagaucacagcaaaaggagcaguuuuguuugugugcuucugagccauggugaagaaggaauaauuuuuggaacaaauggaccuguugaccugaaaaaaauaacaaacuuuuucagaggggaucguuguagaagucuaacuggaaaacccaaacuuuucauuauucaggccugccgugguacagaacuggacuguggcauugagacagacagugguguugaugaugacauggcgugucauaaaauaccaguggaggccgacuucuuguaugcauacuccacagcaccugguuauuauucuuggcgaaauucaaaggauggcuccugguucauccagucgcuuugugccaugcugaaacaguaugccgacaagcuugaauuuaugcacauucuuacccggguuaaccgaaagguggcaacagaauuugaguccuuuuccuuugacgcuacuuuucaugcaaagaaacagauuccauguauuguuuccaugcucacaaaagaacucuauuuuuaucacuaaagaaaugguugguuggugguuuuuuuuaguuuguaugccaagugagaagaugguauauuugguacuguauuucccucucauuuugaccuacucucaugcugcagaggguacuuuaagacauacuccuuccaucaaauagaaccacuaugaagcuaccucaaacuuccagucagguaguugcaauugaauuaaauuaggaauaaauaaaaauggauacuggugcagucauuaugagaggcaaugauuguuaauuuacagcuuucaugauuagcaaguuacagugaugcugugcuaugaauuuucaaguaauugugaaaaaguuaaacauugaaguaaugaauuuuuaugauauuccccccacuuaagacuguguauucuaguuuugucaaacuguagaaaugaugauguggaagaacuuaggcaucugugggcauggucaaaggcucaaaccuuuauuuuagaauugauauacacggaugacuuaacugcauuuuuagaccauuuaucugggauuaugguuuugugauguuuguccugaacacuuuuguuguaaaaaaauaauaauaauguuuaauauugagaaagaaacuaauauuuuaugugagagaaagugugagcaaacuaacuugacuuuuaaggcuaaaacuuaacauucauagagggguggaguuuuaacuguaaggugcuacaaugccccuggaucuaccagcauaaauaucuucugauuugucccuaugcauaucaguugagcuucauauaccagcaauauaucugaagagcuauuauauaaaaaccccaaacuguugauuauuagccagguaaugugaauaaauucuauaggaacauaugaaaauacaacuuaaauaauaaacaguggaauauaaggaaagcaauaaaugaaugggcugagcugccuguaacuugagaguagaugguuugagccugagcagagacaugacucagccuguuccaugaaggcagagccauggaccacgcaggaagggccuacagcccauuucuccauacgcacugguauguguggaugaugcugccagggcgccaucgccaaguaagaaagugaagcaaaucagaaacuugugaaguggaaauguucuaaagguggugaggcaauaaaaaucauaguacucuuuguagcaaaauucuuaaguauguuauuuucuguugaaguuuacaaucaaaggaaaauaguaauguuuuauacuguuuacugaaagaaaaagaccuaugagcacauaggacucuagacggcauccagccggaggccagagcugagcccucagcccgggaggcaggcuccaggccucagcaggugcggagccgucacugcaccaagucucacuggcugucaguaugacauuucacgggagauuucuuguugcucaaaaaaugagcucgcauuugucaaugacaguuucuuuuuucuuacuagaccuguaacuuuuguaaauacacauagcauguaaugguaucuuaaaguguguuucuaugugacaauuuuguacaaauuuguuauuuuccauuuuuauuucaaaauauacauucaaacuuaaaauuaaaaaaaaaaaaaaaaa

SEQ ID NO: 26 - RNA, 2034 nt, Homo_Sapiens
ggcccuggggcgggggcggguccuggggacuggggcgggcggccgaggcccggaagcggacugaggcggccuggagucuuaguuggcuacucgccauggacgaagcggaucggcggcuccugcggcggugccggcugcggcugguggaagagcugcagguggaccagcucugggacgcccugcugagccgcgagcuguucaggccccauaugaucgaggacauccagcgggcaggcucuggaucucggcgggaucaggccaggcagcugaucauagaucuggagacucgagggagucaggcucuuccuuuguucaucuccugcuuagaggacacaggccaggacaugcuggcuucguuucugcgaacuaacaggcaagcagcaaaguugucgaagccaacccuagaaaaccuuaccccaguggugcucagaccagagauucgcaaaccagagguucucagaccggaaacacccagaccaguggacauugguucuggaggauuuggugaugucggugcucuugagaguuugaggggaaaugcagauuuggcuuacauccugagcauggagcccuguggccacugccucauuaucaacaaugugaacuucugccgugaguccgggcuccgcacccgcacuggcuccaacaucgacugugagaaguugcggcgucgcuucuccucgcugcauuucaugguggaggugaagggcgaccugacugccaagaaaauggugcuggcuuugcuggagcuggcgcagcaggaccacggugcucuggacugcugcgugguggucauucucucucacggcugucaggccagccaccugcaguucccaggggcugucuacggcacagauggaugcccugugucggucgagaagauugugaacaucuucaaugggaccagcugccccagccugggagggaagcccaagcucuuuuucauccaggccugugguggggagcagaaagaccauggguuugagguggccuccacuuccccugaagacgaguccccuggcaguaaccccgagccagaugccaccccguuccaggaagguuugaggaccuucgaccagcuggacgccauaucuaguuugcccacacccagugacaucuuuguguccuacucuacuuucccagguuuuguuuccuggagggaccccaagaguggcuccugguacguugagacccuggacgacaucuuugagcagugggcucacucugaagaccugcagucccuccugcuuagggucgcuaaugcuguuucggugaaagggauuuauaaacagaugccugguugcuuuaauuuccuccggaaaaaacuuuucuuuaaaacaucauaaggccagggccccucacccugccuuaucuugcaccccaaagcuuuccugccccaggccugaaagaggcugaggccuggacuuuccugcaacucaaggacuuugcagccggcacagggucugcucuuucucugccagugacagacaggcucuuagcagcuuccagauugacgacaagugcugaacaguggaggaagagggacagaugaaugccguggauugcacguggccucuugagcaguggcugguccagggcuagugacuugugucccaugaucccuguguugucucuagagcagggauuaaccucugcacuacugacauguggggccaggucacccuuugcugugaggcuguccuguacauugugggauguucagcacugucccuugccucaaugccaguaacgcgucuuccugaguggugccaaacaaaaagguucucagguguugccaaauauguccugggguauaaaacuuuccucgccugacaaccacuggucuguagggauuuuuggcuacacacaaaccaguaucgcucauagaucagcaaaccggggccuacuagagucugaacagcuguaaucuaugaauucuaagugaaauuuuaaaaauuguuaauuuuuccuauauugcauuaauuuuaaaaaaaaaaaaaaaaaaaaaaaaaaaaaaaaaaaaaaaaaaaaaaa

SEQ ID NO: 27 - RNA, 1584 nt, Homo_Sapiens
ggcccuggggcgggggcggguccuggggacuggggcgggcggccgaggcccggaagcggacugaggcggccuggagucuuaguuggcuacucgccauggacgaagcggaucggcggcuccugcggcggugccggcugcggcugguggaagagcugcagguggaccagcucugggacgcccugcugagccgcgagcuguucaggccccauaugaucgaggacauccagcgggcaggcucuggaucucggcgggaucaggccaggcagcugaucauagaucuggagacucgagggagucaggcucuuccuuuguucaucuccugcuuagaggacacaggccaggacaugcuggcuucguuucugcgaacuaacaggcaagcagcaaaguugucgaagccaacccuagaaaaccuuaccccaguggugcucagaccagagauucgcaaaccagagguucucagaccggaaacacccagaccaguggacauugguucuggaggauuuggugaugucgagcagaaagaccauggguuugagguggccuccacuuccccugaagacgaguccccuggcaguaaccccgagccagaugccaccccguuccaggaagguuugaggaccuucgaccagcuggacgccauaucuaguuugcccacacccagugacaucuuuguguccuacucuacuuucccagguuuuguuuccuggagggaccccaagaguggcuccugguacguugagacccuggacgacaucuuugagcagugggcucacucugaagaccugcagucccuccugcuuagggucgcuaaugcuguuucggugaaagggauuuauaaacagaugccugguugcuuuaauuuccuccggaaaaaacuuuucuuuaaaacaucauaaggccagggccccucacccugccuuaucuugcaccccaaagcuuuccugccccaggccugaaagaggcugaggccuggacuuuccugcaacucaaggacuuugcagccggcacagggucugcucuuucucugccagugacagacaggcucuuagcagcuuccagauugacgacaagugcugaacaguggaggaagagggacagaugaaugccguggauugcacguggccucuugagcaguggcugguccagggcuagugacuugugucccaugaucccuguguugucucuagagcagggauuaaccucugcacuacugacauguggggccaggucacccuuugcugugaggcuguccuguacauugugggauguucagcacugucccuugccucaaugccaguaacgcgucuuccugaguggugccaaacaaaaagguucucagguguugccaaauauguccugggguauaaaacuuuccucgccugacaaccacuggucuguagggauuuuuggcuacacacaaaccaguaucgcucauagaucagcaaaccggggccuacuagagucugaacagcuguaaucuaugaauucuaagugaaauuuuaaaaauuguuaauuuuuccuauauugcauuaauuuuaaaaaaaaaaaaaaaaaaaaaaaaaaaaaaaaaaaaaaaaaaaaaaa

SEQ ID NO: 28 - RNA, 3937 nt, Homo_Sapiens
auaaguuagcgccgcucuccgccucggcagugccagccgccaguggucgcacuuggagggucucgccgccaguggaaggagccaccgcccccgcccgaccauggccgaggagcuggucuuagagaggugugaucuggagcuggagaccaauggccgagaccaccacacggccgaccugugccgggagaagcugguggugcgacggggccagcccuucuggcugacccugcacuuugagggccgcaacuacgaggccaguguagacagucucaccuucagugucgugaccggcccagccccuagccaggaggccgggaccaaggcccguuuuccacuaagagaugcuguggaggagggugacuggacagccaccgugguggaccagcaagacugcacccucucgcugcagcucaccaccccggccaacgcccccaucggccuguaucgccucagccuggaggccuccacuggcuaccagggauccagcuuugugcugggccacuucauuuugcucuucaacgccuggugcccagcggaugcuguguaccuggacucggaagaggagcggcaggaguauguccucacccagcagggcuuuaucuaccagggcucggccaaguucaucaagaacauaccuuggaauuuugggcaguuugaagaugggauccuagacaucugccugauccuucuagaugucaaccccaaguuccugaagaacgccggccgugacugcucccgccgcagcagccccgucuacgugggccggguggugaguggcauggucaacugcaacgaugaccagggugugcugcugggacgcugggacaacaacuacggggacggcgucagccccauguccuggaucggcagcguggacauccugcggcgcuggaagaaccacggcugccagcgcgucaaguauggccagugcugggucuucgccgccguggccugcacagugcugaggugccugggcaucccuacccgcgucgugaccaacuacaacucggcccaugaccagaacagcaaccuucucaucgaguacuuccgcaaugaguuuggggagauccagggugacaagagcgagaugaucuggaacuuccacugcuggguggagucguggaugaccaggccggaccugcagccgggguacgagggcuggcaggcccuggacccaacgccccaggagaagagcgaagggacguacugcuguggcccaguuccaguucgugccaucaaggagggcgaccugagcaccaaguacgaugcgcccuuugucuuugcggaggucaaugccgacgugguagacuggauccagcaggacgaugggucugugcacaaauccaucaaccguucccugaucguugggcugaagaucagcacuaagagcgugggccgagacgagcgggaggauaucacccacaccuacaaauacccagagggguccucagaggagagggaggccuucacaagggcgaaccaccugaacaaacuggccgagaaggaggagacagggauggccaugcggauccgugugggccagagcaugaacaugggcagugacuuugacgucuuugcccacaucaccaacaacaccgcugaggaguacgucugccgccuccugcucugugcccgcaccgucagcuacaaugggaucuuggggcccgaguguggcaccaaguaccugcucaaccucaaccuggagccuuucucugagaagagcguuccucuuugcauccucuaugagaaauaccgugacugccuuacggaguccaaccucaucaaggugcgggcccuccucguggagccaguuaucaacagcuaccugcuggcugagagggaccucuaccuggagaauccagaaaucaagauccggauccuuggggagcccaagcagaaacgcaagcugguggcugaggugucccugcagaacccgcucccuguggcccuggaaggcugcaccuucacuguggagggggccggccugacugaggagcagaagacgguggagaucccagaccccguggaggcaggggaggaaguuaaggugagaauggaccugcugccgcuccacaugggccuccacaagcugguggugaacuucgagagcgacaagcugaaggcugugaagggcuuccggaaugucaucauuggccccgccuaagggaccccugcucccagccugcugagagcccccaccuugaucccaauccuuaucccaagcuagugagcaaaauaugccccuucuugggccccagaccccagggcagggugggcagccuaugggggcucucggaaauggaaugugccccuggcccaucucagccuccugagccuguggguccccacucacccccuuugcugugaggaaugcucugugccagaaacagugggagcccugaccuuggcugacuggggcuggggugagagaggaaagaccuacauucccucuccugcccagaugcccuuuggaaagccauugaccacccaccauauuguuugaucuacuucauagcuccuuggagcaggcaaaaaagggacagcaugccccuuggcuggaucagggaauccagcucccuagacugcaucccguaccucuucccaugacugcacccagcuccaggggcccuugggacagccagagcuggguggggacagugauaggcccaagguccccuccacaucccagcagcccaagcuuaauagcccucccccucaaccucaccauugugaagcaccuacuaugugcugggugccucccacacuugcuggggcucacggggccuccaacccauuuaaucaccaugggaaacuguugugggcgcugcuuccaggauaaggagacugaggcuuagagagaggaggcagcccccuccacaccaguggccucgugguuauuagcaaggcuggguaaugugaaggcccaagagcagagucugggccucugacucugaguccacugcuccauuuauaaccccagccugaccugagacugucggagaggcugucuggggccuuuaucaaaaaaagacucagccaagacaaggagguagagaggggacugggggacugggagucagagcccuggcuggguucaggucccacgucuggccaggcacugccuucuccucucugggccuuuguuuccuuguuggucagaggagugauugaaccagcucaucuccaaggauccucuccacuccauguuugcaaugcuuuuauauggcccagccuuguaaauaaccacaagguccacucccugcuccacgaagccuuaagccauaggcccaggauauuucugagagugaaaccaugacugugaccaccuucuguccccagcccuguccugguuccuuccuaugcccagguaccacccuucagaccccaguucuaggggagaagagcccuggacaccccugcucuacccaugagccugcccgcugcaaugccuagacuucccaacagccuuagcugccagugcuggucacuaaccaacaagguuggcaccccagcuaccccuucuuugcagggcuaaggcccccaaacauagccccugccccggaggaagcuuggggaacccaugaguugucagcuuugacuuuaucuccugcucuuucuacaugacugggccucccuugggcuggaagaauuggggauucucuauuggaggugagaucacagccuccagggccccccaaaucccagggaaggacuuggagagaaucaugcuguugcauuuagaacuuucugcuuugcacaggaaagagucacacaauuaaucaacauguauauuuucucuauacauagagcucuauuucucuacgguuuuauaaaagccuuggguuccaaccaggcaguagaugugcuucugaaccgcaaggagcaaacacugaaauaaaauaguuuauuuuucacacucaaaaaaaaaaaaaaaaaa

SEQ ID NO: 29 - RNA, 1879 nt, Homo_Sapiens
auaaguuagcgccgcucuccgccucggcagugccagccgccaguggucgcacuuggagggucucgccgccaguggaaggagccaccgcccccgcccgaccauggccgaggagcuggucuuagagaggugugaucuggagcuggagaccaauggccgagaccaccacacggccgaccugugccgggagaagcugguggugcgacggggccagcccuucuggcugacccugcacuuugagggccgcaacuacgaggccaguguagacagucucaccuucagugucgugaccggcccagccccuagccaggaggccgggaccaaggcccguuuuccacuaagagaugcuguggaggagggugacuggacagccaccgugguggaccagcaagacugcacccucucgcugcagcucaccaccccggccaacgcccccaucggccuguaucgccucagccuggaggccuccacuggcuaccagggauccagcuuugugcugggccacuucauuuugcucuucaacgccuggugcccagcggaugcuguguaccuggacucggaagaggagcggcaggaguauguccucacccagcagggcuuuaucuaccagggcucggccaaguucaucaagaacauaccuuggaauuuugggcaguuugaagaugggauccuagacaucugccugauccuucuagaugucaaccccaaguuccugaagaacgccggccgugacugcucccgccgcagcagccccgucuacgugggccggguggugaguggcauggucaacugcaacgaugaccagggugugcugcugggacgcugggacaacaacuacggggacggcgucagccccauguccuggaucggcagcguggacauccugcggcgcuggaagaaccacggcugccagcgcgucaaguauggccagugcugggucuucgccgccguggccugcacagugcugaggugccugggcaucccuacccgcgucgugaccaacuacaacucggcccaugaccagaacagcaaccuucucaucgaguacuuccgcaaugaguuuggggagauccagggugacaagagcgagaugaucuggaacuuccacugcuggguggagucguggaugaccaggccggaccugcagccgggguacgagggcuggcaggcccuggacccaacgccccaggagaagagcgaagggacguacugcuguggcccaguuccaguucgugccaucaaggagggcgaccugagcaccaaguacgaugcgcccuuugucuuugcggaggucaaugccgacgugguagacuggauccagcaggacgaugggucugugcacaaauccaucaaccguucccugaucguugggcugaagaucagcacuaagagcgugggccgagacgagcgggaggauaucacccacaccuacaaauacccagagggguccucagaggagagggaggccuucacaagggcgaaccaccugaacaaacuggccgagaaggaggagacagggauggccaugcggauccgugugggccagagcaugaacaugggcagugacuuugacgucuuugcccacaucaccaacaacaccgcugaggaguacgucugccgccuccugcucugugcccgcaccgucagcuacaaugggaucuuggggcccgaguguggcaccaaguaccugcucaaccucaaccuggagccuuucucugguaaagcccuguguuccuggagcauuuguugaccgccaacugacaacaugcuagguagugaccuaaccacuuagcaugugugauuucaccccacagacacuuacauggcgcugacucuggggcaggcccuguccuaagcacuuuauaaauaucaacccacuuaa

SEQ ID NO: 30 - RNA, 4236 nt, Homo_Sapiens
ggugggcggggggaggaggcggcccuagcgccauuuugugggagcgaagcgguggcugggcugcgcuuggguccgucgcugcuucggugucccugucgggcuucccagcagcggccuagcgggaaaaguaaaagaugucugaauauauucggguaaccgaagaugagaacgaugagcccauugaaauaccaucggaagacgaugggacggugcugcucuccacgguuacagcccaguuuccaggggcgugugggcuucgcuacaggaauccagugucucaguguaugagagguguccggcugguagaaggaauucugcaugccccagaugcuggcuggggaaaucugguguauguugucaacuauccaaaagauaacaaaagaaaaauggaugagacagaugcuucaucagcagugaaagugaaaagagcaguccagaaaacauccgauuuaauaguguugggucucccauggaaaacaaccgaacaggaccugaaagaguauuuuaguaccuuuggagaaguucuuauggugcaggucaagaaagaucuuaagacuggucauucaaagggguuuggcuuuguucguuuuacggaauaugaaacacaagugaaaguaaugucacagcgacauaugauagauggacgauggugugacugcaaacuuccuaauucuaagcaaagccaagaugagccuuugagaagcagaaaaguguuuguggggcgcuguacagaggacaugacugaggaugagcugcgggaguucuucucucaguacggggaugugauggaugucuucauccccaagccauucagggccuuugccuuuguuacauuugcagaugaucagauugcgcagucucuuuguggagaggacuugaucauuaaaggaaucagcguucauauauccaaugccgaaccuaagcacaauagcaauagacaguuagaaagaaguggaagauuuggugguaauccagguggcuuugggaaucaggguggauuugguaauagcagaggggguggagcugguuugggaaacaaucaagguaguaauauggguggugggaugaacuuuggugcguucagcauuaauccagccaugauggcugccgcccaggcagcacuacagagcaguugggguaugaugggcauguuagccagccagcagaaccagucaggcccaucggguaauaaccaaaaccaaggcaacaugcagagggagccaaaccaggccuucgguucuggaaauaacucuuauaguggcucuaauucuggugcagcaauugguuggggaucagcauccaaugcagggucgggcagugguuuuaauggaggcuuuggcucaagcauggauucuaagucuucuggcuggggaauguagacagugggguugugguugguugguauagaauggugggaauucaaauuuuucuaaacucaugguaaguauauuguaaaauacauauguacuaagaauuuucaaaauugguuuguucaguguggaguauauucagcaguauuuuugacauuuuucuuuagaaaaaggaagagcuaaaggaauuuuauaaguuuuguuacaugaaagguugaaauauugagugguugaaagugaacugcuguuugccugauugguaaaccaacacacuacaauugauaucaaaagguuucuccuguaauauuuuaucccuggacuugucaagugaauucuuugcauguucaaaacggaaaccauugauuagaacuacauucuuuaccccuuguuuuaauuugaaccccaccauauggauuuuuuuccuuaagaaaaucuccuuuuaggagaucauggugucacaguguuugguucuuuuguuuuguuuuuuaacacuugucuccccucauacacaaaaguacaauaugaagccuucauuuaaucucugcaguucaucucauuucaaauguuuauggaagaagcacuucauugaaaguagugcuguaaauauucugccauaggaauacugucuacaugcuuucucauucaagaauucgucaucacgcaucacaggccgcgucuuugacggugggugucccauuuuuauccgcuacucuuuauuucauggagucguaucaacgcuaugaacgcaaggcugugauauggaaccagaaggcugucugaacuuuugaaaccuugugugggauugaugguggugccgaggcaugaaaggcuaguaugagcgagaaaaggagagagcgcgugcagagacuugguggugcauaauggauauuuuuuaacuuggcgagaugugucucucaauccuguggcuuuggugagagagugugcagagagcaaugauagcaaauaauguacgaauguuuuuugcauucaaaggacauccacaucuguuggaagacuuuuaagugaguuuuuguucuuagauaacccacauuagaugaauguguuaagugaaaugauacuuguacucccccuaccccuuugucaacugcugugaaugcuguaugguguguguucucuucuguuacugauauguaaguguggcaaugugaacugaagcugaugggcugagaacauggacugagcuuguggugugcuuugcaggaggacuugaagcagaguucaccagugagcucaggugucucaaagaaggguggaaguucuaaugucuguuagcuacccauaagaaugcuguuugcugcaguucuguguccugugcuuggaugcuuuuuauaagaguugucauuguuggaaauucuuaaauaaaacugauuuaaauaauaugugucuuuguuuugcagcccugaaugcaaagaauucauagcaguuaauuccccuuuuuugacccuuuugagauggaacuuucauaaaguuucuuggcaguaguuuauuuugcuucaaauaaacuuauuugaaaaguugucucaagucaaauggauucaucaccugucaugcauugacaccugauacccagacuuaauugguauuuguucuugcauuggccaaagugaaaauuuuuuuuuuucuuuugaaaucuaguuuugaauaagucugggugaccgcaccuaaaaugguaagcaguacccuccggcuuuuucuuagugccucugugcauuugggugauguucuauuuacauggccuguguaaaucuccauugggaagucaugccuucuaaaaagauucuuauuugggggagugggcaaaauguugauuauuuucuaaugcuuuguagcaaagcauaucaauugaaaagggaauaucagcaccuuccuaguuugggauuugaaaaguggaauuaauugcaguagggauaaaguagaagaaaccacaaauuaucuugugccugaaauccauuaagaggccugauagcuuuaagaauuaggguggguugucugucuggaaguguuaaguggaaugggcuuuguccuccaggaggugggggaaugugguaacauugaauacaguugaauaaaaucgcuuacaaaacucacacucucacaaugcauuguuaaguauguaaaagcaauaacauugauucucuguuguacuuuuuuguaacuaauucugugagaguugagcucauuuucuaguuggaagaaugugauauuuguuguguugguaguuuaccuaaugcccuuaccuaauuagauuaugauaaauagguuugucauuuugcaaguuacauaaacauuuaucaaugaagucauccuuuagacuuguaaucgccacauuguuucauuauucaguuuccucuguaaagggaucuugaguuguuuuaauuuuuuuuuucugcaucugaaucugcaugauuuccaaacccuguaccaucugaauuuugcauuuuagcacuugcacuauuacucagcagcaguaacaugguaacacuuaaaaugguacucggggaccuccaaagacuaaacugacaagccuucaaggagcccagggguaaguuaacuugucaacggcaugguuuaaucccuucuuuacacuuguguaaauuucaguuacuggucauagaaggcuuucaauguugaguggccuuuuauuaacauguuuaugguacugcauagauacggguauuuauuuuacccuaagaagauuuugaaguuuaaaaguacuuaaacuauuuggcaaagauuuguuuuuaaaaaucuauuuggucaaucuaaaugcauucauucuaaaaaauuuuuugaaccagauaaauaaaauuuuuuuuugacaccacaaaaaaaaaaaaaaaaaaaa

SEQ ID NO: 31 - RNA, 2862 nt, Homo_Sapiens
gcaccacgccgcccgggcuucugggguguuccccaaccacggcccagcccugccacaccccccgcccccggccuccgcagcucggcaugggcgcgggggugcucguccugggcgccuccgagcccgguaaccugucgucggccgcaccgcuccccgacggcgcggccaccgcggcgcggcugcuggugcccgcgucgccgcccgccucguugcugccucccgccagcgaaagccccgagccgcugucucagcaguggacagcgggcaugggucugcugauggcgcucaucgugcugcucaucguggcgggcaaugugcuggugaucguggccaucgccaagacgccgcggcugcagacgcucaccaaccucuucaucaugucccuggccagcgccgaccuggucauggggcugcugguggugccguucggggccaccaucgugguguggggccgcugggaguacggcuccuucuucugcgagcuguggaccucaguggacgugcugugcgugacggccagcaucgagacccugugugucauugcccuggaccgcuaccucgccaucaccucgcccuuccgcuaccagagccugcugacgcgcgcgcgggcgcggggccucgugugcaccgugugggccaucucggcccugguguccuuccugcccauccucaugcacugguggcgggcggagagcgacgaggcgcgccgcugcuacaacgaccccaagugcugcgacuucgucaccaaccgggccuacgccaucgccucguccguagucuccuucuacgugccccugugcaucauggccuucguguaccugcggguguuccgcgaggcccagaagcaggugaagaagaucgacagcugcgagcgccguuuccucggcggcccagcgcggccgcccucgcccucgcccucgcccguccccgcgcccgcgccgccgcccggacccccgcgccccgccgccgccgccgccaccgccccgcuggccaacgggcgugcggguaagcggcggcccucgcgccucguggcccugcgcgagcagaaggcgcucaagacgcugggcaucaucaugggcgucuucacgcucugcuggcugcccuucuuccuggccaacguggugaaggccuuccaccgcgagcuggugcccgaccgccucuucgucuucuucaacuggcugggcuacgccaacucggccuucaaccccaucaucuacugccgcagccccgacuuccgcaaggccuuccagggacugcucugcugcgcgcgcagggcugcccgccggcgccacgcgacccacggagaccggccgcgcgccucgggcugucuggcccggcccggacccccgccaucgcccggggccgccucggacgacgacgacgacgaugucgucggggccacgccgcccgcgcgccugcuggagcccugggccggcugcaacggcggggcggcggcggacagcgacucgagccuggacgagccgugccgccccggcuucgccucggaauccaagguguagggcccggcgcggggcgcggacuccgggcacggcuucccaggggaacgaggagaucuguguuuacuuaagaccgauagcaggugaacucgaagcccacaauccucgucugaaucauccgaggcaaagagaaaagccacggaccguugcacaaaaaggaaaguuugggaagggaugggagaguggcuugcugauguuccuuguuguuuuuuuuuucuuuucuuuucuuucuucuucuuuuuuuuuuuuuuuuuuuuuucuguuugugguccggccuucuuuugugugugcgugugaugcaucuuuagauuuuuuucccccaccaggugguuuuugacacucucugagaggaccggaguggaagauggguggguuaggggaagggagaagcauuaggaggggauuaaaaucgaucaucguggcucccaucccuuucccgggaacaggaacacacuaccagccagagagaggagaaugacaguuugucaagacauauuuccuuuugcuuuccagagaaauuucauuuuaauuucuaaguaaugauuucugcuguuaugaaagcaaagagaaaggauggaggcaaaauaaaaaaaaaucacguuucaagaaauguuaagcucuucuuggaacaagccccaccuugcuuuccuuguguagggcaaacccgcugucccccgcgcgccuggguggucaggcugagggauuucuaccucacacugugcauuugcacagcagauagaaagacuuguuuauauuaaacagcuuauuuauguaucaauauuaguuggaaggaccaggcgcagagccucucucugugacaugugacucugucaauugaagacaggacauuaaaagagagcgagagagagaaacaguucagauuacugcacauguggauaaaaacaaaaacaaaaaaaaggagugguucaaaaugccauuuuugcacaguguuaggaauuacaaaauccacagaagauguuacuugcacaaaaagaaauuaaauauuuuuuaaagggagaggggcugggcagaucuuaaauaaaauucaaacucuacuucuguugucuaguauguuauugagcuaaugauucauugggaaaauaccuuuuuauacuccuuuaucaugguacuguaacuguauccauauuauaaauauaauuaucuuaaggauuuuuuauuuuuuuuuauguccaagugcccacgugaauuugcuggugaaaguuagcacuuguguguaaauucuacuuccucuuguguguuuuaccaaguauuuauacucuggugcaacuaacuacugugugaggaauugguccaugugcaauaaauaccaaugaagcacaaucaa

SEQ ID NO: 32 - RNA, 4918 nt, Homo_Sapiens
gguugccauggggaccuggaugcugacgaaggcucgcgaggcugugagcagccacagugcccugcucagaagccccgggcucgucagucaaaccgguucucuguuugcacucggcagcacgggcaggcaaguggucccuagguucgggagcagagcagcagcgccucaguccuggucccccagucccaagccucaccugccugcccagcgccaggauggccaccaucaccugcacccgcuucacggaagaguaccagcucuucgaggaauugggcaagggagccuucucgguggugcgaaggugugugaaggugcuggcuggccaggaguaugcugccaagaucaucaacacaaagaagcugucagccagagaccaucagaagcuggagcgugaagcccgcaucugccgccugcugaagcaccccaacaucguccgacuacaugacagcaucucagaggagggacaccacuaccugaucuucgaccuggucacugguggggaacuguuugaagauaucguggcccgggaguauuacagugaggcggaugccagucacuguauccagcagauccuggaggcugugcugcacugccaccagauggggguggugcaccgggaccugaagccugagaaucuguugcuggccuccaagcucaagggugccgcagugaagcuggcagacuuuggccuggccauagagguggagggggagcagcaggcaugguuuggguuugcagggacuccuggauaucucuccccagaagugcugcggaaggacccguacgggaagccuguggaccugugggcuuguggggucauccuguacauccugcugguuggguaccccccguucugggaugaggaccagcaccgccuguaccagcagaucaaagccggcgccuaugauuucccaucgccggaaugggacacugucaccccggaagccaaggaucugaucaauaagaugcugaccauuaacccauccaaacgcaucacagcugccgaagcccuuaagcaccccuggaucucgcaccgcuccaccguggcauccugcaugcacagacaggagaccguggacugccugaagaaguucaaugccaggaggaaacugaagggagccauucucaccacgaugcuggccaccaggaacuucuccggagggaagagugggggaaacaagaagagcgauggugugaagaaaagaaaguccaguuccagcguucaguuaauggaauccucagagagcaccaacaccaccaucgaggaugaagacaccaaagugcggaaacaggaaauuauaaaagugacagagcagcugauugaagccauaagcaauggagauuuugaguccuacacgaagaugugcgacccuggcaugacagccuucgaaccugaggcccuggggaaccugguugagggccuggacuuccaucgauucuauuuugaaaaccuguggucccggaacagcaagcccgugcacaccaccauccugaauccccacauccaccugaugggcgacgagucagccugcaucgccuacauccgcaucacgcaguaccuggacgcuggcggcaucccacgcaccgcccagucggaggagacccgugucuggcaccgccgggauggcaaauggcagaucguccacuuccacagaucuggggcgcccuccguccugccccacugagggaccaggcuggggucgcugcguugcugugccgcagagauccacucuguccguggaguggagcugcugguucucccagguggauuuugcuggaauucucccaugucaucaccccaccaccgucacuucuguaccugcaucaagaaaaccugcuuguucacaaaagucaucgcaacuucagagcgaacggccacaucuccccaccucucacccccacccucuccccugccaggcuggggcuuccucaggcauggguguccacagcacuggcccccucuccccagccucagcugcuguccgccugaucugucuugggcuguaggcuagaaugcccgggcuggugcccaccaggggcuggggagaaggagggguggcaugaugaggaaggcagcauccguccgucccucucccagaccucuccucuuccaguguccccggggaagggcagaugacacucccuucccccuaagccaaccgcacugaaggaguggggagaagagcauacgccaggagccuccugccucaaagugcuccccuaagucuucuuccuccugugcugaccucaggguggucugacccuucccucggugugggggauguggcccucucaggugccccuacuugcuuucugcuuccuucuggugaaguccaccuccaacauuaaccugcccaccccacccccgucaucccuggagaauuccagcuuugucguaucucagagagggaaucuaauuguuuuuggggggcaaaagaaagcaacguuuagguaucacuucuacuuggaccgcaugccuuuuuauagccaaauuucuguguauuucguaaauggauuucgcguuaauggauauuuauguaauaacuagacuucucagauuauugugagaagggucagguuggaagggguguaggaagaggggugagggguaguuuuuuucuguucuaguuuuuuuuuuuuuuuuugucaucucugagguggaccuugucaccugugguuauuggggccaagguggacucagcuccggggagaagggccucucugccauuucggucccaaggugagcugacacaggcguuccuuuugggacuguggaagcaucagaugccagcacugacucaggaacagcaagucagggcagagaggaggagggaggcugucaggauggaaauaccuggacuuuucuuugcuucccucgcaaacuggggucuucucuaccgaacuucccaggauuucaucucaccauaucugugugccgcccccagcaccccccacccaccucuggggggcccgugagcgugugucuucauugccucucuccccuuggcgucugaugaccacagcaaagcacugggaauuucuacucuucaugccucauccugcagccucggguucgcauucucucuuucuuuuccucuuucccucuuucccugggauugacucugaguggaauaccuuggcacauccacuaggaucuacugucugcacuguuuucuuugcaugacuuuauacgcaguaaguauguugaaaacaaacaaaaagaagaaaacacucaacaaaaccaaucuacauguuuuggacuaaaaaaaaaaauagagguuguauucucaguguccgacucggaauuauguugcugccucucugugcuuuuggccucuguguggccguguuuugccagcaugagauacuguccccucuggaggauuuuaggggaggaagagccacguccccagggauuggaggaggcuccgguacccucgacccuccuggguguugguuggagcagaacuggugaggauguuugauccgagauuuucugagcucuccccaaucaccagcugucugcuggguucuuuucucaaguccugcugcccaggcccaggugagacaggcaacgccaggucugcaggccaggagagaugcugcccaggccuccugguuuccaagcugguccaucacuggccucuguccuuggcagagaccuugcugcccaggcccaggggcaggcucuuggccugccccaggcccagagggcuucccaguaaggcccagugaucccauuaucccaggggcaaaaccaccuguccccuuuugagcugccaguucccuacagccauccccagucaagggugaggguguggccuucaccaggggcugcuguaauuaccgagcaaggucugagcucuucuucagccucaguucccucauugguuaaaaggguucuuuguucccauccagccgaugaaggagcaaacgucuggcuaugugaagccuaauuuaccugcaggaacuggcagggauagucacuggcuggacuccuguuuacuucuagaccuggucaggcuccauccccucccccaccugccccugauuccccucgucggugccugucaacugcuuuucagcaguggacugcaggggaaagagcagugauuuggggugaguaggcuucaauucccagcucugaccagacuugcugugugaccuugggcaaguuccuuucccucuuuggagcuugguuucccugccagaggaaacugagcuggaggagccugagguccugccuuucauuggcugacacaccuccuguccacugugucacucuccaagugccagagaaguggaggcagaucgcuaccccaggcugagauggcccccacugugaaggccacgccugugggugggcagccaccuggugccaccacagggcaccagggaugauccugauguggcaggcaggggagacucacagaaaaaucugcccagagccuacccucaccagacaaacucugugcuccuccaaaacauccuuuagaugcaaaauaauaauaauaauaauaauaaauaaauaaauaaaaauccaaacccaagucaaaaccuuggcuccagcaugaaaacacguuuacaggaaaguguucuccuggguuugugcccaccauggugcgaauccugacccaaggccuccugucucccuucaaagggagacccuuuugggggaugaguuugccagacuccccgugcugguuucuuuguuacuauuuguuugggguuuuguuuuaguucuuuuuuuuuuucuuuucuuuuuuaaaaauauguggcugugaacuugaaugaacacugcucaaacuuucugcuauuggggggggcgggugggaugggaagaaggggcguuuguuuuauucuugguguuuucagugcaauaaauagcuacaaacuucugugcaaaaaaaaaaaaaaa

SEQ ID NO: 33 - RNA, 4885 nt, Homo_Sapiens
gguugccauggggaccuggaugcugacgaaggcucgcgaggcugugagcagccacagugcccugcucagaagccccgggcucgucagucaaaccgguucucuguuugcacucggcagcacgggcaggcaaguggucccuagguucgggagcagagcagcagcgccucaguccuggucccccagucccaagccucaccugccugcccagcgccaggauggccaccaucaccugcacccgcuucacggaagaguaccagcucuucgaggaauugggcaagggagccuucucgguggugcgaaggugugugaaggugcuggcuggccaggaguaugcugccaagaucaucaacacaaagaagcugucagccagagaccaucagaagcuggagcgugaagcccgcaucugccgccugcugaagcaccccaacaucguccgacuacaugacagcaucucagaggagggacaccacuaccugaucuucgaccuggucacugguggggaacuguuugaagauaucguggcccgggaguauuacagugaggcggaugccagucacuguauccagcagauccuggaggcugugcugcacugccaccagauggggguggugcaccgggaccugaagccugagaaucuguugcuggccuccaagcucaagggugccgcagugaagcuggcagacuuuggccuggccauagagguggagggggagcagcaggcaugguuuggguuugcagggacuccuggauaucucuccccagaagugcugcggaaggacccguacgggaagccuguggaccugugggcuuguggggucauccuguacauccugcugguuggguaccccccguucugggaugaggaccagcaccgccuguaccagcagaucaaagccggcgccuaugauuucccaucgccggaaugggacacugucaccccggaagccaaggaucugaucaauaagaugcugaccauuaacccauccaaacgcaucacagcugccgaagcccuuaagcaccccuggaucucgcaccgcuccaccguggcauccugcaugcacagacaggagaccguggacugccugaagaaguucaaugccaggaggaaacugaagggagccauucucaccacgaugcuggccaccaggaacuucuccggagggaagagugggggaaacaagaagagcgauggugugaaggaauccucagagagcaccaacaccaccaucgaggaugaagacaccaaagugcggaaacaggaaauuauaaaagugacagagcagcugauugaagccauaagcaauggagauuuugaguccuacacgaagaugugcgacccuggcaugacagccuucgaaccugaggcccuggggaaccugguugagggccuggacuuccaucgauucuauuuugaaaaccuguggucccggaacagcaagcccgugcacaccaccauccugaauccccacauccaccugaugggcgacgagucagccugcaucgccuacauccgcaucacgcaguaccuggacgcuggcggcaucccacgcaccgcccagucggaggagacccgugucuggcaccgccgggauggcaaauggcagaucguccacuuccacagaucuggggcgcccuccguccugccccacugagggaccaggcuggggucgcugcguugcugugccgcagagauccacucuguccguggaguggagcugcugguucucccagguggauuuugcuggaauucucccaugucaucaccccaccaccgucacuucuguaccugcaucaagaaaaccugcuuguucacaaaagucaucgcaacuucagagcgaacggccacaucuccccaccucucacccccacccucuccccugccaggcuggggcuuccucaggcauggguguccacagcacuggcccccucuccccagccucagcugcuguccgccugaucugucuugggcuguaggcuagaaugcccgggcuggugcccaccaggggcuggggagaaggagggguggcaugaugaggaaggcagcauccguccgucccucucccagaccucuccucuuccaguguccccggggaagggcagaugacacucccuucccccuaagccaaccgcacugaaggaguggggagaagagcauacgccaggagccuccugccucaaagugcuccccuaagucuucuuccuccugugcugaccucaggguggucugacccuucccucggugugggggauguggcccucucaggugccccuacuugcuuucugcuuccuucuggugaaguccaccuccaacauuaaccugcccaccccacccccgucaucccuggagaauuccagcuuugucguaucucagagagggaaucuaauuguuuuuggggggcaaaagaaagcaacguuuagguaucacuucuacuuggaccgcaugccuuuuuauagccaaauuucuguguauuucguaaauggauuucgcguuaauggauauuuauguaauaacuagacuucucagauuauugugagaagggucagguuggaagggguguaggaagaggggugagggguaguuuuuuucuguucuaguuuuuuuuuuuuuuuuugucaucucugagguggaccuugucaccugugguuauuggggccaagguggacucagcuccggggagaagggccucucugccauuucggucccaaggugagcugacacaggcguuccuuuugggacuguggaagcaucagaugccagcacugacucaggaacagcaagucagggcagagaggaggagggaggcugucaggauggaaauaccuggacuuuucuuugcuucccucgcaaacuggggucuucucuaccgaacuucccaggauuucaucucaccauaucugugugccgcccccagcaccccccacccaccucuggggggcccgugagcgugugucuucauugccucucuccccuuggcgucugaugaccacagcaaagcacugggaauuucuacucuucaugccucauccugcagccucggguucgcauucucucuuucuuuuccucuuucccucuuucccugggauugacucugaguggaauaccuuggcacauccacuaggaucuacugucugcacuguuuucuuugcaugacuuuauacgcaguaaguauguugaaaacaaacaaaaagaagaaaacacucaacaaaaccaaucuacauguuuuggacuaaaaaaaaaaauagagguuguauucucaguguccgacucggaauuauguugcugccucucugugcuuuuggccucuguguggccguguuuugccagcaugagauacuguccccucuggaggauuuuaggggaggaagagccacguccccagggauuggaggaggcuccgguacccucgacccuccuggguguugguuggagcagaacuggugaggauguuugauccgagauuuucugagcucuccccaaucaccagcugucugcuggguucuuuucucaaguccugcugcccaggcccaggugagacaggcaacgccaggucugcaggccaggagagaugcugcccaggccuccugguuuccaagcugguccaucacuggccucuguccuuggcagagaccuugcugcccaggcccaggggcaggcucuuggccugccccaggcccagagggcuucccaguaaggcccagugaucccauuaucccaggggcaaaaccaccuguccccuuuugagcugccaguucccuacagccauccccagucaagggugaggguguggccuucaccaggggcugcuguaauuaccgagcaaggucugagcucuucuucagccucaguucccucauugguuaaaaggguucuuuguucccauccagccgaugaaggagcaaacgucuggcuaugugaagccuaauuuaccugcaggaacuggcagggauagucacuggcuggacuccuguuuacuucuagaccuggucaggcuccauccccucccccaccugccccugauuccccucgucggugccugucaacugcuuuucagcaguggacugcaggggaaagagcagugauuuggggugaguaggcuucaauucccagcucugaccagacuugcugugugaccuugggcaaguuccuuucccucuuuggagcuugguuucccugccagaggaaacugagcuggaggagccugagguccugccuuucauuggcugacacaccuccuguccacugugucacucuccaagugccagagaaguggaggcagaucgcuaccccaggcugagauggcccccacugugaaggccacgccugugggugggcagccaccuggugccaccacagggcaccagggaugauccugauguggcaggcaggggagacucacagaaaaaucugcccagagccuacccucaccagacaaacucugugcuccuccaaaacauccuuuagaugcaaaauaauaauaauaauaauaauaaauaaauaaauaaaaauccaaacccaagucaaaaccuuggcuccagcaugaaaacacguuuacaggaaaguguucuccuggguuugugcccaccauggugcgaauccugacccaaggccuccugucucccuucaaagggagacccuuuugggggaugaguuugccagacuccccgugcugguuucuuuguuacuauuuguuugggguuuuguuuuaguucuuuuuuuuuuucuuuucuuuuuuaaaaauauguggcugugaacuugaaugaacacugcucaaacuuucugcuauuggggggggcgggugggaugggaagaaggggcguuuguuuuauucuugguguuuucagugcaauaaauagcuacaaacuucugugcaaaaaaaaaaaaaaa

SEQ ID NO: 34 - RNA, 2435 nt, Homo_Sapiens
cgcuccggcugcagcgccggcugcaucaauaauucagagcggcggcggcggcggcagcggcgggugcgggcaggaggcggcggcagcagcgggaccgagcagcagcggcuaugcauccaagugcggcugggcagccgcggcaccccugaggcccgggaggggcuccgggaacacagcgcggaggggacgcuagucgcggaggggacgcuagucccggagugcgaggaagagguguaguguccagagcggcggcggcggagcugcgcacggagcugaggagggggcuucggagcgggacugggacggggggggcggcuggcgcgagcagcccuggggguggggggcggggugggcgccggcggcgcgaugcugggcguccuggagcugcugcugcugggggcugcguggcuggcgggcccggcccgcgggcagaaugagacggagcccaucgugcuggagggcaagugccugguggugugcgacuccaaccccacguccgaccccacgggcacugcccugggcaucucugugcgcucuggcagcgccaagguggcuuucucugccaucaggagcaccaaccacgagccguccgagaugaguaaucgcaccaugaucaucuacuucgaccagguacuagugaacauugggaacaacuuugauucagaacgcagcacuuucaucgccccgcgcaaagggaucuacaguuuuaacuuccacgugguaaaagucuacaacagacaaaccauacaggugagccucaugcuaaacggguggccggugauuucagccuucgcuggugaccaggacgugacccgggaggccgccagcaacggaguccuaauccaaauggagaaaggcgaccgagcauaccucaagcuggagcggggaaacuugauggggggcuggaaguacucgaccuucuccggauuccugguguuuccucucugacuggcucguagccggaagggaggcagggagagggcgaaggcaggaaggggagugagaaagaggcugaaauuaagagggcgagaaagcagcacgacuugaaacuuccuacauguucucuaacuguaucuggguaaaaaggugcgcgccagcugugggacaacuuuguccauuuccuuauuaggagaaauaaauuucgcuuagcucugcgcacucccauuuccaaaaauaaacucgccucccccauuccaguugcaguaaucaagaaagagacugccuugucauuguuucuuaucccccaacuucauguucccugcaauuuauuuaaagaaacuuuguauuucacuacauaaucugaaaucuuucucccuagcccccucugaauccuucugccuacugaaaucugauauauuacacacccccaaccuuuuuuuuuucaguuuggaaagggguaaaguuuuguuguuguuguuguuuuguuuuggauggggaagguaguuuuaauuuggcaaguguugcucuucuuaaaacacugcucaaauuaauuagcugaagauacuuaguauccucggcugcuuguuagcagagaaaggacucaccuuaguggugacugguuuaaaaaauauaaauauauaucauuuguauacgaagaacucuucccaguggaaacuggcuguguuuccguauuucuauguucuauucggagugaucgugaaaucuaaggcugcuugauguucugaugcuugucaaugccgucgugcucugugacuccacgaaacgccaaggagcuucuuccggacgccuccucuuccucuguaacauacgugugaauagucaagguuuaauuuugcuuuaaucuaauaaagucgaagugggacuuuuauuuuucugaaacagcuuucuaaaauccgcaucuuccccagcugcgagguugggggucuggggugccaaagggcgagguuccgaaaggcaggagacuugggggaacgcaaccauagaaaggccugggcgcgagggcuuccuugcaaagccggccuugcgcuccuuccugcgccaggccggggaccagcacugcauucgccuguguucacagcuuuggcggaaacguaagaaauguggccgaaaucuugcuaggccaggcgcggccgccggcccaggagcgaaguuugauuuuuuucuuugcauuccaaaugcaucaggaauagucccaguuugaggacccaaacgacccugccuggagcggcagacuccucaggccuucuguccccggaugucucccaccgcgucccccucgcaguucccgaagcagcguauguuuuauacaccgccucugaauccggaguccacccgccgcauacucgggcgcccaggaccuaugauuccgcucauucacaggacuuuauucaagagguucguccaggaguuuugauuguaucggaacauaaugugaaagcaaaaaugaaauaaacgacuucguuuuaagucugaaa

SEQ ID NO: 35 - RNA, 3870 nt, Homo_Sapiens
gagcgccgggaccgcggcggcggggccgcggcgcgcauugcggagggcgcggagcgcaggagcugccgccugccgggcagauccaagggggcagcacgcuucccgggagcgcccccgccuccucuccggggccgccgcaggcucggugagcgguuuuaucccuccggccggcaggcugggcgcgcaggggcgcgagcccccgcccggcgcgcagcagcaccaugggcacggugcugucccugucucccagcuaccggaaggccacgcuguuugaggauggcgcggccaccgugggccacuauacggccguacagaacagcaagaacgccaaggacaagaaccugaagcgccacuccaucaucuccgugcugccuuggaagagaaucguggccgugucggccaagaagaagaacuccaagaaggugcagcccaacagcagcuaccagaacaacaucacgcaccucaacaaugagaaccugaagaagucgcugucgugcgccaaccuguccacauucgcccagcccccaccggcccagccgccugcacccccggccagccagcucucggguucccagaccgggggcuccuccucagucaagaaagccccucacccugccgucaccuccgcagggacgcccaaacgggucaucguccaggcguccaccagugagcugcuucgcugccugggugaguuucucugccgccggugcuaccgccugaagcaccugucccccacggaccccgugcucuggcugcgcagcguggaccgcucgcugcuucugcagggcuggcaggaccagggcuucaucacgccggccaacguggucuuccucuacaugcucugcagggauguuaucuccuccgaggugggcucggaucacgagcuccaggccguccugcugacaugccuguaccucuccuacuccuacaugggcaacgagaucuccuacccgcucaagcccuuccugguggagagcugcaaggaggccuuuugggaccguugccucucugucaucaaccucaugagcucaaagaugcugcagauaaaugccgacccacacuacuucacacaggucuucuccgaccugaagaacgagagcggccaggaggacaagaagcggcuccuccuaggccuggaucggugagcacuguagccugcgucauggcucaaggauucaaugcauuuuuaagaauuuauuauuaaaucaguuuuguguacaguaugugucuagcaaagccaccaagggccucaccuuucccacagucucucccugggguuuuuuucaucccugccaagaacucugggcacuuuugaacucacgagccuugcgcaaaacccagaagauguauucagagccacccaggccacugaccucccacuuuggggaacucaaaggacugaccugccccugccgccugugcccuugcuggguccaggguaggcaaggcugccggcugcacccuguauggagcuagagaggggccucuggcugccuggcccagggaggaauugggguuucugguuggaggcccuuuucuggcuccuguguggaguuauucacucucccagaggcuccuggagccagccacccuaacugagcugccaguggggucgugaggcaagauccccgccacccggggacaucuucaaucuaggcgaggcgaagcugagcgggucuaguggaaagauugugucuggucguuugaccacacaccgcccugauuugcuguuuucuuuuuuuagggagaagggcuuuucuuuaguggagaaauggaacucgccccccuacccccuugucugcugcucccagccacguuggugguauuggccgaugagcugguuugacucauuaauuucucucaauuugggucccagcuaaagagguggggugaagcuggggacagcuuuccugggugaguuuuucuuuugaauaauguagugcagucacccuguggcaaaugccaggacagcugcaggugcccauuagcaacgccugccuucugggcaaggugagggaugccauaccuugagaccaagccggugcccaccuaagggcuaaggccucuugcuggugcacaugacauuuguccugcagagcuggggggaaggcgauguggugaccccacccccacccguuaauuuaaagcuguuucuaaacaguugaguuucuucuaaagaggaagccuugcccagcaaggaccagugagacagccggaucuuggagacaauuacaagacggggagugagacuccugauugcucuggaagccugcugauuucuacaacugaucauuugcagcugcugguuuugguuuccaccuuacccuacuggcuguaaaaacacaaauguguacuuuauugauuuucuuucuaauucucccgcauugguggcuugggacuugggagagggagcaagccuuccuccauggcccaucacucggcuguggagaacaaagaccaaugugaagacacuacagaggauucugucuuccaggcccaguccacuggggagugcuggaauggggaccugggguggggaggcagagggucacuuuacauaggauuaaguucgagguggcuaccgauuucagcacaugcacuacugaaauuuacacaaaaagaaagcugugaaauugaagucccaauuuaagaguccugaggcagaaccugguggcuggaggcauucccagagguggggaagagagccugcccggccggagaacaucugccuugcugcaccugaggcccagcagagccguuccugggacugucagauaaucggugcagcgguggaaggagccugcggcugcuggcacagacuucacacagcaccuccucucugcuggguuuccacacagccugucuucagauccugcugccgcgugcgaccagaggugggaggccccugguggcauggaagagggagggucagugccaagucucaggaggagggcgcauguguguaucacccucagcuggcggaaccuggcugcgaacugugcaguuacguugcauccacaggauuccaguugcgugucuguuuccuucucuuucuccguauuuauuuuuuuauucuucggaggagguggacauuucggaagugguggggacuaagggaagaacucucuaguucccucagugugaagccugucguguucucuccccuugcacuggucaucaguauuguguaaaggaacaacugauauacuugagugugcaagcaaagaacccauuugccaugcugcuaugaagacuacuuuuagaucaacaauaaaaaaaaaccuacaaaaaaaccuuuauucuuuaauuguugcuuuuacggugauauugugcaugcaaaccaggagcauuuugugucuuaagaaaaauaaucuuagaacagauggcugugaaaauuacacccaugcacagaacaagccacaggaauaauaguucaggauuugguuuuucucuuuuucuuguaaaccuggaggguugauauauucuuuccaugcaguuauuagaacuuaguuuuguuccaacaguuaaacuugcaaugaaaagaaaaugugccauuuuuuucacucagaauuauucauagcuguauauuugaaacugcuaauuacacacgugugauguauguugguuuuuuagugcaauuucuucuguagcuauucuuugaccaaacuguggguauuguuaauauuaauuuauauuugucucauuuuguauguauguguaguguguuugugaguaugugugguuuauaaucugacaaagucaugaagcucaguuuggcuguaauuuaauuccccuucccuuauuuuuauuuauuuuuguacugugcugauucaauaaaaugcacugaccauccaaaaaaaaaaaaaaaaa

SEQ ID NO: 36 - RNA, 4376 nt, Homo_Sapiens
aacagaagaugccggagaaggggggggaaaaguagaugcggauuucguccugacuucuaaaaauuccuccucucccucucccauuuuccuaauccgagaaugauggagcucgaggcaaaggaaugauuccggaaauggagauaugauucucaaaccuagaaaugaucggagugauuuauuaguuaaauauucuucguccaggaacccagcacaauucagagcugcagauuggauauugggaagcaaauuugggugugaaaucuucagcaaaggagcacgcagaguccaugauggcucagaccaagugagugagaggcagagcgaggacgccccucugcucuggcgcgcccggacucggacucgcagacucgcgcuggcuccagucucuccacgauucucucucccagacuuuuccccggucuuaagagauccuguguccagagggggccuuagcugcuccagcccgcgaugaggaaaaguccaggucugucugacugucuuugggccuggauccuccuucugagcacacugacuggaagaagcuauggacagccgucauuacaagaugaacuuaaagacaauaccacugucuucaccaggauuuuggacagacuccuagaugguuaugacaaucgccugagaccaggauugggagagcguguaaccgaagugaagacugauaucuucgucaccaguuucggacccguuucagaccaugauauggaauauacaauagauguauuuuuccgucaaagcuggaaggaugaaagguuaaaauuuaaaggaccuaugacaguccuccgguuaaauaaccuaauggcaaguaaaaucuggacuccggacacauuuuuccacaauggaaagaagucaguggcccacaacaugaccaugcccaacaaacuccugcggaucacagaggauggcaccuugcuguacaccaugaggcugacagugagagcugaauguccgaugcauuuggaggacuucccuauggaugcccaugcuugcccacuaaaauuuggaaguuaugcuuauacaagagcagaaguuguuuaugaauggaccagagagccagcacgcucagugguuguagcagaagauggaucacgucuaaaccaguaugaccuucuuggacaaacaguagacucuggaauuguccagucaaguacaggagaauauguuguuaugaccacucauuuccacuugaagagaaagauuggcuacuuuguuauucaaacauaccugccaugcauaaugacagugauucucucacaagucuccuucuggcucaacagagagucuguaccagcaagaacugucuuuggaguaacaacugugcucaccaugacaacauugagcaucagugccagaaacucccucccuaagguggcuuaugcaacagcuauggauugguuuauugccgugugcuaugccuuuguguucucagcucugauugaguuugccacaguaaacuauuucacuaagagagguuaugcaugggauggcaaaagugugguuccagaaaagccaaagaaaguaaaggauccucuuauuaagaaaaacaacacuuacgcuccaacagcaaccagcuacaccccuaauuuggccaggggcgacccgggcuuagccaccauugcuaaaagugcaaccauagaaccuaaagaggucaagcccgaaacaaaaccaccagaacccaagaaaaccuuuaacagugucagcaaaauugaccgacugucaagaauagccuucccgcugcuauuuggaaucuuuaacuuagucuacugggcuacguauuuaaacagagagccucagcuaaaagcccccacaccacaucaauagaucuuuuacucacauucuguuguucaguccucugcacugggaauuuauuuauguucucaacgcaguaauucccaucugcuuuauugccucugucuuaaagaauuugaaaguuuccuuauuuucauaauucauuuaagaacaagagaccccugucuggcagucuggagcaaagcagacuaugcagcuuggagacaggauucugacagagcaagcgaaagagcaaagucaugucagaaggagacagaaugagagagaaaagagggggaagaugguucaaagauacaagaaaaaguagaaaaaaaaauaacacuuaacuaaaaccccuaggucauuuguagauauauauuuccaaauauucuaaaaaagauacuguauaugucaaaaauauuuuuaugugaagguguuucaaaggguaaauuauaaauguuucaugaagaaaaaauuuuaaaaaucuacgucuuuauuacacaaacuauggugugcuuauguuuuuguuuugcuuuuuaaacugauguauagcuuuaacauuuuguuuccaaagcugaagauccccauucuuucucuuugaaaaaaaaaaaggccuaaugcauuauuuugucauaaaaugcuauuuuaaaauucauggaacuuucauacguaaaggugcaguugcucauuguagagcacauuuaguccaaugaagauaaaugcuuuaaauaguuuacuucacuuucaucugagcuuuuaccacuagacucaaggaagaauaauuuuaacagacauguauacuccauagaaacuaaacuaaaauaguuuaaaaauauucccuuuuucacccuauuuucagauagcacaugagcccaacacucacuuaauucucauuaugaagauguuuuuagaggggcaaaaauauuuugcaagcucuggaauuguugaauguauucuuuuauauaacuacauuaaaagcuuuagauugaaauuuaugacuagcaaacaaaaauagaauauauaaacgauauauguaaauauacagcaugagauuguacauuuuuuacuuuuuuaaaauuguguucuuaaaauauuguguaagaaucacugcacuuagcuguuggaauguuguuaaaugcuauggaaauacauuuagaaccugcauuuaagaacagaacagcaaguaugaaccacauggaacuuaaaacauaugggugugaaguccacuuauguagacaaaacuuauaauuuccaaacuguugucuaguauacagugaucaguugcucucuguucaagucauuccacacauuucccuauuuuaggcuauuauaauauagaaagaaaaugggaagcauuaguuggagcuagaaaaugaacuguauauuauugcuauauuugcuaauaccaacuauuucaauaaguguuguaccauauguagcauuaaauauaaaauacauaaaagaauguacagaaaauagcuuuuauugaguaauauuacauuucauuuauacuguagcaauauauuuguagguauacuauguaagggcuuuaaauaaaagagguccauuaauacuuccuuauaaaaauucuagucuguuucauuacugcccagauguuuuagagauaaauauuuaugcagaagguauuuuugaagucuccuuuugucugauagaguuuaacagauauuuaaauuuagugcucagaauccacaagucacggucuaaacacacuuagaauacuacagcauaaaucuguuagcauuauugccaaauaagacaguugggauccaaacccaagucuugagcaauguuuuucucaaaaagcugcuauccaaugauauaggaaaauacauuguguuuuccuaaacacacuuuucuuuuuaaaugugcuucauuguuugauuugguccugccuaaauuucacaagcuaggccaaugaaggcugaaucaaagacauuucauccaccaauaucauguguagauauuauguauagaaaauaaaauaaauuauggcucuaacuucuguguugcuguuuaucuuguuauuuuucggcguuauacuaauguguuuauugagagcauuuuaccuuccagacuucucauggcuaacuuuuggucuguauuuugcuccuuagaugugaauauuucuuauuagucugcuuccugcuacgcaaugacugcauuucuaucauuucucaguuuguuaguauauguggauaguauucuacuguauaaaugauugcaaaguuuaucaaaaacaaauuauuauauguagcuuuucuacagugcuuugcuaaaccauguaguacuaguuaagucuuccuugaaaauaaagauacacucuuauaggggacaguuccuguucacucccaggaaacuuuuuuaaaagaugacacugaauguuuauugcacuuuagugcagugaaguggcaauaaaaccuaacaugaaucaagguuguuuauggcagaugcauguguugcuuuacagaguuuagcaaaagcucuuaauuuuaugucauacuguauucuacugaauaauaaagcuaacauuauucaauaauaaaauggaa

SEQ ID NO: 37 - RNA, 4263 nt, Homo_Sapiens
gggagagaggcgagacgagugcucuccccacacguguaacccugcaucucccaguuucagagcuugcguucauucauaugcaggcagugguuuaauauuugaucaaagcugcagauuggauauugggaagcaaauuugggugugaaaucuucagcaaaggagcacgcagaguccaugauggcucagaccaagugagugagaggcagagcgaggacgccccucugcucuggcgcgcccggacucggacucgcagacucgcgcuggcuccagucucuccacgauucucucucccagacuuuuccccggucuuaagagauccuguguccagagggggccuuagcugcuccagcccgcgaugaggaaaaguccaggucugucugacugucuuugggccuggauccuccuucugagcacacugacuggaagaagcuauggacagccgucauuacaagaugaacuuaaagacaauaccacugucuucaccaggauuuuggacagacuccuagaugguuaugacaaucgccugagaccaggauugggagagcguguaaccgaagugaagacugauaucuucgucaccaguuucggacccguuucagaccaugauauggaauauacaauagauguauuuuuccgucaaagcuggaaggaugaaagguuaaaauuuaaaggaccuaugacaguccuccgguuaaauaaccuaauggcaaguaaaaucuggacuccggacacauuuuuccacaauggaaagaagucaguggcccacaacaugaccaugcccaacaaacuccugcggaucacagaggauggcaccuugcuguacaccaugaggcugacagugagagcugaauguccgaugcauuuggaggacuucccuauggaugcccaugcuugcccacuaaaauuuggaaguuaugcuuauacaagagcagaaguuguuuaugaauggaccagagagccagcacgcucagugguuguagcagaagauggaucacgucuaaaccaguaugaccuucuuggacaaacaguagacucuggaauuguccagucaaguacaggagaauauguuguuaugaccacucauuuccacuugaagagaaagauuggcuacuuuguuauucaaacauaccugccaugcauaaugacagugauucucucacaagucuccuucuggcucaacagagagucuguaccagcaagaacugucuuuggaguaacaacugugcucaccaugacaacauugagcaucagugccagaaacucccucccuaagguggcuuaugcaacagcuauggauugguuuauugccgugugcuaugccuuuguguucucagcucugauugaguuugccacaguaaacuauuucacuaagagagguuaugcaugggauggcaaaagugugguuccagaaaagccaaagaaaguaaaggauccucuuauuaagaaaaacaacacuuacgcuccaacagcaaccagcuacaccccuaauuuggccaggggcgacccgggcuuagccaccauugcuaaaagugcaaccauagaaccuaaagaggucaagcccgaaacaaaaccaccagaacccaagaaaaccuuuaacagugucagcaaaauugaccgacugucaagaauagccuucccgcugcuauuuggaaucuuuaacuuagucuacugggcuacguauuuaaacagagagccucagcuaaaagcccccacaccacaucaauagaucuuuuacucacauucuguuguucaguccucugcacugggaauuuauuuauguucucaacgcaguaauucccaucugcuuuauugccucugucuuaaagaauuugaaaguuuccuuauuuucauaauucauuuaagaacaagagaccccugucuggcagucuggagcaaagcagacuaugcagcuuggagacaggauucugacagagcaagcgaaagagcaaagucaugucagaaggagacagaaugagagagaaaagagggggaagaugguucaaagauacaagaaaaaguagaaaaaaaaauaacacuuaacuaaaaccccuaggucauuuguagauauauauuuccaaauauucuaaaaaagauacuguauaugucaaaaauauuuuuaugugaagguguuucaaaggguaaauuauaaauguuucaugaagaaaaaauuuuaaaaaucuacgucuuuauuacacaaacuauggugugcuuauguuuuuguuuugcuuuuuaaacugauguauagcuuuaacauuuuguuuccaaagcugaagauccccauucuuucucuuugaaaaaaaaaaaggccuaaugcauuauuuugucauaaaaugcuauuuuaaaauucauggaacuuucauacguaaaggugcaguugcucauuguagagcacauuuaguccaaugaagauaaaugcuuuaaauaguuuacuucacuuucaucugagcuuuuaccacuagacucaaggaagaauaauuuuaacagacauguauacuccauagaaacuaaacuaaaauaguuuaaaaauauucccuuuuucacccuauuuucagauagcacaugagcccaacacucacuuaauucucauuaugaagauguuuuuagaggggcaaaaauauuuugcaagcucuggaauuguugaauguauucuuuuauauaacuacauuaaaagcuuuagauugaaauuuaugacuagcaaacaaaaauagaauauauaaacgauauauguaaauauacagcaugagauuguacauuuuuuacuuuuuuaaaauuguguucuuaaaauauuguguaagaaucacugcacuuagcuguuggaauguuguuaaaugcuauggaaauacauuuagaaccugcauuuaagaacagaacagcaaguaugaaccacauggaacuuaaaacauaugggugugaaguccacuuauguagacaaaacuuauaauuuccaaacuguugucuaguauacagugaucaguugcucucuguucaagucauuccacacauuucccuauuuuaggcuauuauaauauagaaagaaaaugggaagcauuaguuggagcuagaaaaugaacuguauauuauugcuauauuugcuaauaccaacuauuucaauaaguguuguaccauauguagcauuaaauauaaaauacauaaaagaauguacagaaaauagcuuuuauugaguaauauuacauuucauuuauacuguagcaauauauuuguagguauacuauguaagggcuuuaaauaaaagagguccauuaauacuuccuuauaaaaauucuagucuguuucauuacugcccagauguuuuagagauaaauauuuaugcagaagguauuuuugaagucuccuuuugucugauagaguuuaacagauauuuaaauuuagugcucagaauccacaagucacggucuaaacacacuuagaauacuacagcauaaaucuguuagcauuauugccaaauaagacaguugggauccaaacccaagucuugagcaauguuuuucucaaaaagcugcuauccaaugauauaggaaaauacauuguguuuuccuaaacacacuuuucuuuuuaaaugugcuucauuguuugauuugguccugccuaaauuucacaagcuaggccaaugaaggcugaaucaaagacauuucauccaccaauaucauguguagauauuauguauagaaaauaaaauaaauuauggcucuaacuucuguguugcuguuuaucuuguuauuuuucggcguuauacuaauguguuuauugagagcauuuuaccuuccagacuucucauggcuaacuuuuggucuguauuuugcuccuuagaugugaauauuucuuauuagucugcuuccugcuacgcaaugacugcauuucuaucauuucucaguuuguuaguauauguggauaguauucuacuguauaaaugauugcaaaguuuaucaaaaacaaauuauuauauguagcuuuucuacagugcuuugcuaaaccauguaguacuaguuaagucuuccuugaaaauaaagauacacucuuauaggggacaguuccuguucacucccaggaaacuuuuuuaaaagaugacacugaauguuuauugcacuuuagugcagugaaguggcaauaaaaccuaacaugaaucaagguuguuuauggcagaugcauguguugcuuuacagaguuuagcaaaagcucuuaauuuuaugucauacuguauucuacugaauaauaaagcuaacauuauucaauaauaaaauggaa

SEQ ID NO: 38 - RNA, 4412 nt, Homo_Sapiens
aaaaagagaagcuugcagcagauuguagaaggauuugagccugcagcuagagagaaggggauuagggccagaguggugcaaguuaaauugugcugcauauaaaaaaugggcggauuggucuccagauccagaggcugguaccaccuuccuuucuaaaauaaaaucucucuggcaugaagucaccgccuauuucacauccgguuugcccugggacguauuacuacugucuugguaaagagaaaucuuuuguuguauagcugcagauuggauauugggaagcaaauuugggugugaaaucuucagcaaaggagcacgcagaguccaugauggcucagaccaagugagugagaggcagagcgaggacgccccucugcucuggcgcgcccggacucggacucgcagacucgcgcuggcuccagucucuccacgauucucucucccagacuuuuccccggucuuaagagauccuguguccagagggggccuuagcugcuccagcccgcgaugaggaaaaguccaggucugucugacugucuuugggccuggauccuccuucugagcacacugacuggaagaagcuauggacagccgucauuacaagaugaacuuaaagacaauaccacugucuucaccaggauuuuggacagacuccuagaugguuaugacaaucgccugagaccaggauugggagagcguguaaccgaagugaagacugauaucuucgucaccaguuucggacccguuucagaccaugauauggaauauacaauagauguauuuuuccgucaaagcuggaaggaugaaagguuaaaauuuaaaggaccuaugacaguccuccgguuaaauaaccuaauggcaaguaaaaucuggacuccggacacauuuuuccacaauggaaagaagucaguggcccacaacaugaccaugcccaacaaacuccugcggaucacagaggauggcaccuugcuguacaccaugaggcugacagugagagcugaauguccgaugcauuuggaggacuucccuauggaugcccaugcuugcccacuaaaauuuggaaguuaugcuuauacaagagcagaaguuguuuaugaauggaccagagagccagcacgcucagugguuguagcagaagauggaucacgucuaaaccaguaugaccuucuuggacaaacaguagacucuggaauuguccagucaaguacaggagaauauguuguuaugaccacucauuuccacuugaagagaaagauuggcuacuuuguuauucaaacauaccugccaugcauaaugacagugauucucucacaagucuccuucuggcucaacagagagucuguaccagcaagaacugucuuuggaguaacaacugugcucaccaugacaacauugagcaucagugccagaaacucccucccuaagguggcuuaugcaacagcuauggauugguuuauugccgugugcuaugccuuuguguucucagcucugauugaguuugccacaguaaacuauuucacuaagagagguuaugcaugggauggcaaaagugugguuccagaaaagccaaagaaaguaaaggauccucuuauuaagaaaaacaacacuuacgcuccaacagcaaccagcuacaccccuaauuuggccaggggcgacccgggcuuagccaccauugcuaaaagugcaaccauagaaccuaaagaggucaagcccgaaacaaaaccaccagaacccaagaaaaccuuuaacagugucagcaaaauugaccgacugucaagaauagccuucccgcugcuauuuggaaucuuuaacuuagucuacugggcuacguauuuaaacagagagccucagcuaaaagcccccacaccacaucaauagaucuuuuacucacauucuguuguucaguccucugcacugggaauuuauuuauguucucaacgcaguaauucccaucugcuuuauugccucugucuuaaagaauuugaaaguuuccuuauuuucauaauucauuuaagaacaagagaccccugucuggcagucuggagcaaagcagacuaugcagcuuggagacaggauucugacagagcaagcgaaagagcaaagucaugucagaaggagacagaaugagagagaaaagagggggaagaugguucaaagauacaagaaaaaguagaaaaaaaaauaacacuuaacuaaaaccccuaggucauuuguagauauauauuuccaaauauucuaaaaaagauacuguauaugucaaaaauauuuuuaugugaagguguuucaaaggguaaauuauaaauguuucaugaagaaaaaauuuuaaaaaucuacgucuuuauuacacaaacuauggugugcuuauguuuuuguuuugcuuuuuaaacugauguauagcuuuaacauuuuguuuccaaagcugaagauccccauucuuucucuuugaaaaaaaaaaaggccuaaugcauuauuuugucauaaaaugcuauuuuaaaauucauggaacuuucauacguaaaggugcaguugcucauuguagagcacauuuaguccaaugaagauaaaugcuuuaaauaguuuacuucacuuucaucugagcuuuuaccacuagacucaaggaagaauaauuuuaacagacauguauacuccauagaaacuaaacuaaaauaguuuaaaaauauucccuuuuucacccuauuuucagauagcacaugagcccaacacucacuuaauucucauuaugaagauguuuuuagaggggcaaaaauauuuugcaagcucuggaauuguugaauguauucuuuuauauaacuacauuaaaagcuuuagauugaaauuuaugacuagcaaacaaaaauagaauauauaaacgauauauguaaauauacagcaugagauuguacauuuuuuacuuuuuuaaaauuguguucuuaaaauauuguguaagaaucacugcacuuagcuguuggaauguuguuaaaugcuauggaaauacauuuagaaccugcauuuaagaacagaacagcaaguaugaaccacauggaacuuaaaacauaugggugugaaguccacuuauguagacaaaacuuauaauuuccaaacuguugucuaguauacagugaucaguugcucucuguucaagucauuccacacauuucccuauuuuaggcuauuauaauauagaaagaaaaugggaagcauuaguuggagcuagaaaaugaacuguauauuauugcuauauuugcuaauaccaacuauuucaauaaguguuguaccauauguagcauuaaauauaaaauacauaaaagaauguacagaaaauagcuuuuauugaguaauauuacauuucauuuauacuguagcaauauauuuguagguauacuauguaagggcuuuaaauaaaagagguccauuaauacuuccuuauaaaaauucuagucuguuucauuacugcccagauguuuuagagauaaauauuuaugcagaagguauuuuugaagucuccuuuugucugauagaguuuaacagauauuuaaauuuagugcucagaauccacaagucacggucuaaacacacuuagaauacuacagcauaaaucuguuagcauuauugccaaauaagacaguugggauccaaacccaagucuugagcaauguuuuucucaaaaagcugcuauccaaugauauaggaaaauacauuguguuuuccuaaacacacuuuucuuuuuaaaugugcuucauuguuugauuugguccugccuaaauuucacaagcuaggccaaugaaggcugaaucaaagacauuucauccaccaauaucauguguagauauuauguauagaaaauaaaauaaauuauggcucuaacuucuguguugcuguuuaucuuguuauuuuucggcguuauacuaauguguuuauugagagcauuuuaccuuccagacuucucauggcuaacuuuuggucuguauuuugcuccuuagaugugaauauuucuuauuagucugcuuccugcuacgcaaugacugcauuucuaucauuucucaguuuguuaguauauguggauaguauucuacuguauaaaugauugcaaaguuuaucaaaaacaaauuauuauauguagcuuuucuacagugcuuugcuaaaccauguaguacuaguuaagucuuccuugaaaauaaagauacacucuuauaggggacaguuccuguucacucccaggaaacuuuuuuaaaagaugacacugaauguuuauugcacuuuagugcagugaaguggcaauaaaaccuaacaugaaucaagguuguuuauggcagaugcauguguugcuuuacagaguuuagcaaaagcucuuaauuuuaugucauacuguauucuacugaauaauaaagcuaacauuauucaauaauaaaauggaa

SEQ ID NO: 39 - RNA, 4000 nt, Homo_Sapiens
gagagagagagagagaagaaggagagcgagcgagcgagcaagggagcgagcaggacaggagccugaucccacagcagcugcuccagcccgcgaugaggaaaaguccaggucugucugacugucuuugggccuggauccuccuucugagcacacugacuggaagaagcuauggacagccgucauuacaagaugaacuuaaagacaauaccacugucuucaccaggauuuuggacagacuccuagaugguuaugacaaucgccugagaccaggauugggagagcguguaaccgaagugaagacugauaucuucgucaccaguuucggacccguuucagaccaugauauggaauauacaauagauguauuuuuccgucaaagcuggaaggaugaaagguuaaaauuuaaaggaccuaugacaguccuccgguuaaauaaccuaauggcaaguaaaaucuggacuccggacacauuuuuccacaauggaaagaagucaguggcccacaacaugaccaugcccaacaaacuccugcggaucacagaggauggcaccuugcuguacaccaugaggcugacagugagagcugaauguccgaugcauuuggaggacuucccuauggaugcccaugcuugcccacuaaaauuuggaaguuaugcuuauacaagagcagaaguuguuuaugaauggaccagagagccagcacgcucagugguuguagcagaagauggaucacgucuaaaccaguaugaccuucuuggacaaacaguagacucuggaauuguccagucaaguacaggagaauauguuguuaugaccacucauuuccacuugaagagaaagauuggcuacuuuguuauucaaacauaccugccaugcauaaugacagugauucucucacaagucuccuucuggcucaacagagagucuguaccagcaagaacugucuuuggaguaacaacugugcucaccaugacaacauugagcaucagugccagaaacucccucccuaagguggcuuaugcaacagcuauggauugguuuauugccgugugcuaugccuuuguguucucagcucugauugaguuugccacaguaaacuauuucacuaagagagguuaugcaugggauggcaaaagugugguuccagaaaagccaaagaaaguaaaggauccucuuauuaagaaaaacaacacuuacgcuccaacagcaaccagcuacaccccuaauuuggccaggggcgacccgggcuuagccaccauugcuaaaagugcaaccauagaaccuaaagaggucaagcccgaaacaaaaccaccagaacccaagaaaaccuuuaacagugucagcaaaauugaccgacugucaagaauagccuucccgcugcuauuuggaaucuuuaacuuagucuacugggcuacguauuuaaacagagagccucagcuaaaagcccccacaccacaucaauagaucuuuuacucacauucuguuguucaguccucugcacugggaauuuauuuauguucucaacgcaguaauucccaucugcuuuauugccucugucuuaaagaauuugaaaguuuccuuauuuucauaauucauuuaagaacaagagaccccugucuggcagucuggagcaaagcagacuaugcagcuuggagacaggauucugacagagcaagcgaaagagcaaagucaugucagaaggagacagaaugagagagaaaagagggggaagaugguucaaagauacaagaaaaaguagaaaaaaaaauaacacuuaacuaaaaccccuaggucauuuguagauauauauuuccaaauauucuaaaaaagauacuguauaugucaaaaauauuuuuaugugaagguguuucaaaggguaaauuauaaauguuucaugaagaaaaaauuuuaaaaaucuacgucuuuauuacacaaacuauggugugcuuauguuuuuguuuugcuuuuuaaacugauguauagcuuuaacauuuuguuuccaaagcugaagauccccauucuuucucuuugaaaaaaaaaaaggccuaaugcauuauuuugucauaaaaugcuauuuuaaaauucauggaacuuucauacguaaaggugcaguugcucauuguagagcacauuuaguccaaugaagauaaaugcuuuaaauaguuuacuucacuuucaucugagcuuuuaccacuagacucaaggaagaauaauuuuaacagacauguauacuccauagaaacuaaacuaaaauaguuuaaaaauauucccuuuuucacccuauuuucagauagcacaugagcccaacacucacuuaauucucauuaugaagauguuuuuagaggggcaaaaauauuuugcaagcucuggaauuguugaauguauucuuuuauauaacuacauuaaaagcuuuagauugaaauuuaugacuagcaaacaaaaauagaauauauaaacgauauauguaaauauacagcaugagauuguacauuuuuuacuuuuuuaaaauuguguucuuaaaauauuguguaagaaucacugcacuuagcuguuggaauguuguuaaaugcuauggaaauacauuuagaaccugcauuuaagaacagaacagcaaguaugaaccacauggaacuuaaaacauaugggugugaaguccacuuauguagacaaaacuuauaauuuccaaacuguugucuaguauacagugaucaguugcucucuguucaagucauuccacacauuucccuauuuuaggcuauuauaauauagaaagaaaaugggaagcauuaguuggagcuagaaaaugaacuguauauuauugcuauauuugcuaauaccaacuauuucaauaaguguuguaccauauguagcauuaaauauaaaauacauaaaagaauguacagaaaauagcuuuuauugaguaauauuacauuucauuuauacuguagcaauauauuuguagguauacuauguaagggcuuuaaauaaaagagguccauuaauacuuccuuauaaaaauucuagucuguuucauuacugcccagauguuuuagagauaaauauuuaugcagaagguauuuuugaagucuccuuuugucugauagaguuuaacagauauuuaaauuuagugcucagaauccacaagucacggucuaaacacacuuagaauacuacagcauaaaucuguuagcauuauugccaaauaagacaguugggauccaaacccaagucuugagcaauguuuuucucaaaaagcugcuauccaaugauauaggaaaauacauuguguuuuccuaaacacacuuuucuuuuuaaaugugcuucauuguuugauuugguccugccuaaauuucacaagcuaggccaaugaaggcugaaucaaagacauuucauccaccaauaucauguguagauauuauguauagaaaauaaaauaaauuauggcucuaacuucuguguugcuguuuaucuuguuauuuuucggcguuauacuaauguguuuauugagagcauuuuaccuuccagacuucucauggcuaacuuuuggucuguauuuugcuccuuagaugugaauauuucuuauuagucugcuuccugcuacgcaaugacugcauuucuaucauuucucaguuuguuaguauauguggauaguauucuacuguauaaaugauugcaaaguuuaucaaaaacaaauuauuauauguagcuuuucuacagugcuuugcuaaaccauguaguacuaguuaagucuuccuugaaaauaaagauacacucuuauaggggacaguuccuguucacucccaggaaacuuuuuuaaaagaugacacugaauguuuauugcacuuuagugcagugaaguggcaauaaaaccuaacaugaaucaagguuguuuauggcagaugcauguguugcuuuacagaguuuagcaaaagcucuuaauuuuaugucauacuguauucuacugaauaauaaagcuaacauuauucaauaauaaaauggaa

SEQ ID NO: 40 - RNA, 4067 nt, Homo_Sapiens
ggaaggcacgcucuuguccuggcugcaaaauugccuguuuuucccuuuccaguggacgcuggugaaaugcccucuuguguaggggucucucccauucugaacacgaaaacucaacuuagucuuugauauggauggcaugggaugcugcuccagcccgcgaugaggaaaaguccaggucugucugacugucuuugggccuggauccuccuucugagcacacugacuggaagaagcuauggacagccgucauuacaagaugaacuuaaagacaauaccacugucuucaccaggauuuuggacagacuccuagaugguuaugacaaucgccugagaccaggauugggagagcguguaaccgaagugaagacugauaucuucgucaccaguuucggacccguuucagaccaugauauggaauauacaauagauguauuuuuccgucaaagcuggaaggaugaaagguuaaaauuuaaaggaccuaugacaguccuccgguuaaauaaccuaauggcaaguaaaaucuggacuccggacacauuuuuccacaauggaaagaagucaguggcccacaacaugaccaugcccaacaaacuccugcggaucacagaggauggcaccuugcuguacaccaugaggcugacagugagagcugaauguccgaugcauuuggaggacuucccuauggaugcccaugcuugcccacuaaaauuuggaaguuaugcuuauacaagagcagaaguuguuuaugaauggaccagagagccagcacgcucagugguuguagcagaagauggaucacgucuaaaccaguaugaccuucuuggacaaacaguagacucuggaauuguccagucaaguacaggagaauauguuguuaugaccacucauuuccacuugaagagaaagauuggcuacuuuguuauucaaacauaccugccaugcauaaugacagugauucucucacaagucuccuucuggcucaacagagagucuguaccagcaagaacugucuuuggaguaacaacugugcucaccaugacaacauugagcaucagugccagaaacucccucccuaagguggcuuaugcaacagcuauggauugguuuauugccgugugcuaugccuuuguguucucagcucugauugaguuugccacaguaaacuauuucacuaagagagguuaugcaugggauggcaaaagugugguuccagaaaagccaaagaaaguaaaggauccucuuauuaagaaaaacaacacuuacgcuccaacagcaaccagcuacaccccuaauuuggccaggggcgacccgggcuuagccaccauugcuaaaagugcaaccauagaaccuaaagaggucaagcccgaaacaaaaccaccagaacccaagaaaaccuuuaacagugucagcaaaauugaccgacugucaagaauagccuucccgcugcuauuuggaaucuuuaacuuagucuacugggcuacguauuuaaacagagagccucagcuaaaagcccccacaccacaucaauagaucuuuuacucacauucuguuguucaguccucugcacugggaauuuauuuauguucucaacgcaguaauucccaucugcuuuauugccucugucuuaaagaauuugaaaguuuccuuauuuucauaauucauuuaagaacaagagaccccugucuggcagucuggagcaaagcagacuaugcagcuuggagacaggauucugacagagcaagcgaaagagcaaagucaugucagaaggagacagaaugagagagaaaagagggggaagaugguucaaagauacaagaaaaaguagaaaaaaaaauaacacuuaacuaaaaccccuaggucauuuguagauauauauuuccaaauauucuaaaaaagauacuguauaugucaaaaauauuuuuaugugaagguguuucaaaggguaaauuauaaauguuucaugaagaaaaaauuuuaaaaaucuacgucuuuauuacacaaacuauggugugcuuauguuuuuguuuugcuuuuuaaacugauguauagcuuuaacauuuuguuuccaaagcugaagauccccauucuuucucuuugaaaaaaaaaaaggccuaaugcauuauuuugucauaaaaugcuauuuuaaaauucauggaacuuucauacguaaaggugcaguugcucauuguagagcacauuuaguccaaugaagauaaaugcuuuaaauaguuuacuucacuuucaucugagcuuuuaccacuagacucaaggaagaauaauuuuaacagacauguauacuccauagaaacuaaacuaaaauaguuuaaaaauauucccuuuuucacccuauuuucagauagcacaugagcccaacacucacuuaauucucauuaugaagauguuuuuagaggggcaaaaauauuuugcaagcucuggaauuguugaauguauucuuuuauauaacuacauuaaaagcuuuagauugaaauuuaugacuagcaaacaaaaauagaauauauaaacgauauauguaaauauacagcaugagauuguacauuuuuuacuuuuuuaaaauuguguucuuaaaauauuguguaagaaucacugcacuuagcuguuggaauguuguuaaaugcuauggaaauacauuuagaaccugcauuuaagaacagaacagcaaguaugaaccacauggaacuuaaaacauaugggugugaaguccacuuauguagacaaaacuuauaauuuccaaacuguugucuaguauacagugaucaguugcucucuguucaagucauuccacacauuucccuauuuuaggcuauuauaauauagaaagaaaaugggaagcauuaguuggagcuagaaaaugaacuguauauuauugcuauauuugcuaauaccaacuauuucaauaaguguuguaccauauguagcauuaaauauaaaauacauaaaagaauguacagaaaauagcuuuuauugaguaauauuacauuucauuuauacuguagcaauauauuuguagguauacuauguaagggcuuuaaauaaaagagguccauuaauacuuccuuauaaaaauucuagucuguuucauuacugcccagauguuuuagagauaaauauuuaugcagaagguauuuuugaagucuccuuuugucugauagaguuuaacagauauuuaaauuuagugcucagaauccacaagucacggucuaaacacacuuagaauacuacagcauaaaucuguuagcauuauugccaaauaagacaguugggauccaaacccaagucuugagcaauguuuuucucaaaaagcugcuauccaaugauauaggaaaauacauuguguuuuccuaaacacacuuuucuuuuuaaaugugcuucauuguuugauuugguccugccuaaauuucacaagcuaggccaaugaaggcugaaucaaagacauuucauccaccaauaucauguguagauauuauguauagaaaauaaaauaaauuauggcucuaacuucuguguugcuguuuaucuuguuauuuuucggcguuauacuaauguguuuauugagagcauuuuaccuuccagacuucucauggcuaacuuuuggucuguauuuugcuccuuagaugugaauauuucuuauuagucugcuuccugcuacgcaaugacugcauuucuaucauuucucaguuuguuaguauauguggauaguauucuacuguauaaaugauugcaaaguuuaucaaaaacaaauuauuauauguagcuuuucuacagugcuuugcuaaaccauguaguacuaguuaagucuuccuugaaaauaaagauacacucuuauaggggacaguuccuguucacucccaggaaacuuuuuuaaaagaugacacugaauguuuauugcacuuuagugcagugaaguggcaauaaaaccuaacaugaaucaagguuguuuauggcagaugcauguguugcuuuacagaguuuagcaaaagcucuuaauuuuaugucauacuguauucuacugaauaauaaagcuaacauuauucaauaauaaaauggaa

SEQ ID NO: 41 - RNA, 4223 nt, Homo_Sapiens
agcuuaaaaauuuuaaugcacaguucacuguggaaacugaaaucuuaaaaguccaaauauuuagaugauaaacaacaagaagagaauaaaccaaacuauauucuaaauauaaaaccuagagauaaacaacucacaguuuuuauguugagcaauacugucaccugaaagcguuucagcuuguauucuuuuacaggagaauaaggacacugauauauuucugaauggagaaauggaagggaaaguggagaauggaugguccagguuuccauugcuuccaaugaggugucauaucccagugagcugcuccagcccgcgaugaggaaaaguccaggucugucugacugucuuugggccuggauccuccuucugagcacacugacuggaagaagcuauggacagccgucauuacaagaugaacuuaaagacaauaccacugucuucaccaggauuuuggacagacuccuagaugguuaugacaaucgccugagaccaggauugggagagcguguaaccgaagugaagacugauaucuucgucaccaguuucggacccguuucagaccaugauauggaauauacaauagauguauuuuuccgucaaagcuggaaggaugaaagguuaaaauuuaaaggaccuaugacaguccuccgguuaaauaaccuaauggcaaguaaaaucuggacuccggacacauuuuuccacaauggaaagaagucaguggcccacaacaugaccaugcccaacaaacuccugcggaucacagaggauggcaccuugcuguacaccaugaggcugacagugagagcugaauguccgaugcauuuggaggacuucccuauggaugcccaugcuugcccacuaaaauuuggaaguuaugcuuauacaagagcagaaguuguuuaugaauggaccagagagccagcacgcucagugguuguagcagaagauggaucacgucuaaaccaguaugaccuucuuggacaaacaguagacucuggaauuguccagucaaguacaggagaauauguuguuaugaccacucauuuccacuugaagagaaagauuggcuacuuuguuauucaaacauaccugccaugcauaaugacagugauucucucacaagucuccuucuggcucaacagagagucuguaccagcaagaacugucuuuggaguaacaacugugcucaccaugacaacauugagcaucagugccagaaacucccucccuaagguggcuuaugcaacagcuauggauugguuuauugccgugugcuaugccuuuguguucucagcucugauugaguuugccacaguaaacuauuucacuaagagagguuaugcaugggauggcaaaagugugguuccagaaaagccaaagaaaguaaaggauccucuuauuaagaaaaacaacacuuacgcuccaacagcaaccagcuacaccccuaauuuggccaggggcgacccgggcuuagccaccauugcuaaaagugcaaccauagaaccuaaagaggucaagcccgaaacaaaaccaccagaacccaagaaaaccuuuaacagugucagcaaaauugaccgacugucaagaauagccuucccgcugcuauuuggaaucuuuaacuuagucuacugggcuacguauuuaaacagagagccucagcuaaaagcccccacaccacaucaauagaucuuuuacucacauucuguuguucaguccucugcacugggaauuuauuuauguucucaacgcaguaauucccaucugcuuuauugccucugucuuaaagaauuugaaaguuuccuuauuuucauaauucauuuaagaacaagagaccccugucuggcagucuggagcaaagcagacuaugcagcuuggagacaggauucugacagagcaagcgaaagagcaaagucaugucagaaggagacagaaugagagagaaaagagggggaagaugguucaaagauacaagaaaaaguagaaaaaaaaauaacacuuaacuaaaaccccuaggucauuuguagauauauauuuccaaauauucuaaaaaagauacuguauaugucaaaaauauuuuuaugugaagguguuucaaaggguaaauuauaaauguuucaugaagaaaaaauuuuaaaaaucuacgucuuuauuacacaaacuauggugugcuuauguuuuuguuuugcuuuuuaaacugauguauagcuuuaacauuuuguuuccaaagcugaagauccccauucuuucucuuugaaaaaaaaaaaggccuaaugcauuauuuugucauaaaaugcuauuuuaaaauucauggaacuuucauacguaaaggugcaguugcucauuguagagcacauuuaguccaaugaagauaaaugcuuuaaauaguuuacuucacuuucaucugagcuuuuaccacuagacucaaggaagaauaauuuuaacagacauguauacuccauagaaacuaaacuaaaauaguuuaaaaauauucccuuuuucacccuauuuucagauagcacaugagcccaacacucacuuaauucucauuaugaagauguuuuuagaggggcaaaaauauuuugcaagcucuggaauuguugaauguauucuuuuauauaacuacauuaaaagcuuuagauugaaauuuaugacuagcaaacaaaaauagaauauauaaacgauauauguaaauauacagcaugagauuguacauuuuuuacuuuuuuaaaauuguguucuuaaaauauuguguaagaaucacugcacuuagcuguuggaauguuguuaaaugcuauggaaauacauuuagaaccugcauuuaagaacagaacagcaaguaugaaccacauggaacuuaaaacauaugggugugaaguccacuuauguagacaaaacuuauaauuuccaaacuguugucuaguauacagugaucaguugcucucuguucaagucauuccacacauuucccuauuuuaggcuauuauaauauagaaagaaaaugggaagcauuaguuggagcuagaaaaugaacuguauauuauugcuauauuugcuaauaccaacuauuucaauaaguguuguaccauauguagcauuaaauauaaaauacauaaaagaauguacagaaaauagcuuuuauugaguaauauuacauuucauuuauacuguagcaauauauuuguagguauacuauguaagggcuuuaaauaaaagagguccauuaauacuuccuuauaaaaauucuagucuguuucauuacugcccagauguuuuagagauaaauauuuaugcagaagguauuuuugaagucuccuuuugucugauagaguuuaacagauauuuaaauuuagugcucagaauccacaagucacggucuaaacacacuuagaauacuacagcauaaaucuguuagcauuauugccaaauaagacaguugggauccaaacccaagucuugagcaauguuuuucucaaaaagcugcuauccaaugauauaggaaaauacauuguguuuuccuaaacacacuuuucuuuuuaaaugugcuucauuguuugauuugguccugccuaaauuucacaagcuaggccaaugaaggcugaaucaaagacauuucauccaccaauaucauguguagauauuauguauagaaaauaaaauaaauuauggcucuaacuucuguguugcuguuuaucuuguuauuuuucggcguuauacuaauguguuuauugagagcauuuuaccuuccagacuucucauggcuaacuuuuggucuguauuuugcuccuuagaugugaauauuucuuauuagucugcuuccugcuacgcaaugacugcauuucuaucauuucucaguuuguuaguauauguggauaguauucuacuguauaaaugauugcaaaguuuaucaaaaacaaauuauuauauguagcuuuucuacagugcuuugcuaaaccauguaguacuaguuaagucuuccuugaaaauaaagauacacucuuauaggggacaguuccuguucacucccaggaaacuuuuuuaaaagaugacacugaauguuuauugcacuuuagugcagugaaguggcaauaaaaccuaacaugaaucaagguuguuuauggcagaugcauguguugcuuuacagaguuuagcaaaagcucuuaauuuuaugucauacuguauucuacugaauaauaaagcuaacauuauucaauaauaaaauggaa

SEQ ID NO: 42 - RNA, 4022 nt, Homo_Sapiens
acuucaaagcauucaucuaaacugccucagucagcccuggugguuauaaccugauguuucuugcuagagacauugaucucuacuuauucuacuuuucagcugcuccagcccgcgaugaggaaaaguccaggucugucugacugucuuugggccuggauccuccuucugagcacacugacuggaagaagcuauggacagccgucauuacaagaugaacuuaaagacaauaccacugucuucaccaggauuuuggacagacuccuagaugguuaugacaaucgccugagaccaggauugggagagcguguaaccgaagugaagacugauaucuucgucaccaguuucggacccguuucagaccaugauauggaauauacaauagauguauuuuuccgucaaagcuggaaggaugaaagguuaaaauuuaaaggaccuaugacaguccuccgguuaaauaaccuaauggcaaguaaaaucuggacuccggacacauuuuuccacaauggaaagaagucaguggcccacaacaugaccaugcccaacaaacuccugcggaucacagaggauggcaccuugcuguacaccaugaggcugacagugagagcugaauguccgaugcauuuggaggacuucccuauggaugcccaugcuugcccacuaaaauuuggaaguuaugcuuauacaagagcagaaguuguuuaugaauggaccagagagccagcacgcucagugguuguagcagaagauggaucacgucuaaaccaguaugaccuucuuggacaaacaguagacucuggaauuguccagucaaguacaggagaauauguuguuaugaccacucauuuccacuugaagagaaagauuggcuacuuuguuauucaaacauaccugccaugcauaaugacagugauucucucacaagucuccuucuggcucaacagagagucuguaccagcaagaacugucuuuggaguaacaacugugcucaccaugacaacauugagcaucagugccagaaacucccucccuaagguggcuuaugcaacagcuauggauugguuuauugccgugugcuaugccuuuguguucucagcucugauugaguuugccacaguaaacuauuucacuaagagagguuaugcaugggauggcaaaagugugguuccagaaaagccaaagaaaguaaaggauccucuuauuaagaaaaacaacacuuacgcuccaacagcaaccagcuacaccccuaauuuggccaggggcgacccgggcuuagccaccauugcuaaaagugcaaccauagaaccuaaagaggucaagcccgaaacaaaaccaccagaacccaagaaaaccuuuaacagugucagcaaaauugaccgacugucaagaauagccuucccgcugcuauuuggaaucuuuaacuuagucuacugggcuacguauuuaaacagagagccucagcuaaaagcccccacaccacaucaauagaucuuuuacucacauucuguuguucaguccucugcacugggaauuuauuuauguucucaacgcaguaauucccaucugcuuuauugccucugucuuaaagaauuugaaaguuuccuuauuuucauaauucauuuaagaacaagagaccccugucuggcagucuggagcaaagcagacuaugcagcuuggagacaggauucugacagagcaagcgaaagagcaaagucaugucagaaggagacagaaugagagagaaaagagggggaagaugguucaaagauacaagaaaaaguagaaaaaaaaauaacacuuaacuaaaaccccuaggucauuuguagauauauauuuccaaauauucuaaaaaagauacuguauaugucaaaaauauuuuuaugugaagguguuucaaaggguaaauuauaaauguuucaugaagaaaaaauuuuaaaaaucuacgucuuuauuacacaaacuauggugugcuuauguuuuuguuuugcuuuuuaaacugauguauagcuuuaacauuuuguuuccaaagcugaagauccccauucuuucucuuugaaaaaaaaaaaggccuaaugcauuauuuugucauaaaaugcuauuuuaaaauucauggaacuuucauacguaaaggugcaguugcucauuguagagcacauuuaguccaaugaagauaaaugcuuuaaauaguuuacuucacuuucaucugagcuuuuaccacuagacucaaggaagaauaauuuuaacagacauguauacuccauagaaacuaaacuaaaauaguuuaaaaauauucccuuuuucacccuauuuucagauagcacaugagcccaacacucacuuaauucucauuaugaagauguuuuuagaggggcaaaaauauuuugcaagcucuggaauuguugaauguauucuuuuauauaacuacauuaaaagcuuuagauugaaauuuaugacuagcaaacaaaaauagaauauauaaacgauauauguaaauauacagcaugagauuguacauuuuuuacuuuuuuaaaauuguguucuuaaaauauuguguaagaaucacugcacuuagcuguuggaauguuguuaaaugcuauggaaauacauuuagaaccugcauuuaagaacagaacagcaaguaugaaccacauggaacuuaaaacauaugggugugaaguccacuuauguagacaaaacuuauaauuuccaaacuguugucuaguauacagugaucaguugcucucuguucaagucauuccacacauuucccuauuuuaggcuauuauaauauagaaagaaaaugggaagcauuaguuggagcuagaaaaugaacuguauauuauugcuauauuugcuaauaccaacuauuucaauaaguguuguaccauauguagcauuaaauauaaaauacauaaaagaauguacagaaaauagcuuuuauugaguaauauuacauuucauuuauacuguagcaauauauuuguagguauacuauguaagggcuuuaaauaaaagagguccauuaauacuuccuuauaaaaauucuagucuguuucauuacugcccagauguuuuagagauaaauauuuaugcagaagguauuuuugaagucuccuuuugucugauagaguuuaacagauauuuaaauuuagugcucagaauccacaagucacggucuaaacacacuuagaauacuacagcauaaaucuguuagcauuauugccaaauaagacaguugggauccaaacccaagucuugagcaauguuuuucucaaaaagcugcuauccaaugauauaggaaaauacauuguguuuuccuaaacacacuuuucuuuuuaaaugugcuucauuguuugauuugguccugccuaaauuucacaagcuaggccaaugaaggcugaaucaaagacauuucauccaccaauaucauguguagauauuauguauagaaaauaaaauaaauuauggcucuaacuucuguguugcuguuuaucuuguuauuuuucggcguuauacuaauguguuuauugagagcauuuuaccuuccagacuucucauggcuaacuuuuggucuguauuuugcuccuuagaugugaauauuucuuauuagucugcuuccugcuacgcaaugacugcauuucuaucauuucucaguuuguuaguauauguggauaguauucuacuguauaaaugauugcaaaguuuaucaaaaacaaauuauuauauguagcuuuucuacagugcuuugcuaaaccauguaguacuaguuaagucuuccuugaaaauaaagauacacucuuauaggggacaguuccuguucacucccaggaaacuuuuuuaaaagaugacacugaauguuuauugcacuuuagugcagugaaguggcaauaaaaccuaacaugaaucaagguuguuuauggcagaugcauguguugcuuuacagaguuuagcaaaagcucuuaauuuuaugucauacuguauucuacugaauaauaaagcuaacauuauucaauaauaaaauggaa

SEQ ID NO: 43 - RNA, 3727 nt, Homo_Sapiens
agaaauggcguggcaggggacccagcgagcccagagggauuuugccgcugcuuccucuaccccuguauuucacgcagcucucuaaauugacucagcuccaggcuagugugagaaacaccaacagcaggcccaucucagaucuucacuauggcaacuuaugcaagaaacuguugaauuagacccguuuccuauagaugagaaaccauacaagcugugguauuuaugagccuccauuucuuauacuacugcagugaaccaacauuggaugugaaaauugccuuuugucagggauucgauaaacaaguggaugugucauauauugccaaacauuacaacaugagcaaaagcaaaguugacaaccaguucuacaguguggaagugggagacucaaccuucacaguucucaagcgcuaccagaaucuaaagccuauuggcucuggggcucagggcauaguuugugccgcguaugaugcuguccuugacagaaauguggccauuaagaagcucagcagacccuuucagaaccaaacacaugccaagagagcguaccgggagcugguccucaugaagugugugaaccauaaaaacauuauuaguuuauuaaaugucuucacaccccagaaaacgcuggaggaguuccaagauguuuacuuaguaauggaacugauggaugccaacuuaugucaagugauucagauggaauuagaccaugagcgaaugucuuaccugcuguaccaaauguuguguggcauuaagcaccuccauucugcuggaauuauucacagggauuuaaaaccaaguaacauuguagucaagucugauugcacauugaaaauccuggacuuuggacuggccaggacagcaggcacaagcuucaugaugacuccauauguggugacacguuauuacagagccccugaggucauccuggggaugggcuacaaggagaacguggauauauggucugugggaugcauuaugggagaaaugguucgccacaaaauccucuuuccaggaagggacuauauugaccaguggaauaagguaauugaacaacuaggaacaccauguccagaauucaugaagaaauugcaacccacaguaagaaacuauguggagaaucggcccaaguaugcgggacucaccuuccccaaacucuucccagauucccucuucccagcggacuccgagcacaauaaacucaaagccagccaagccagggacuuguugucaaagaugcuagugauugacccagcaaaaagaauaucaguggacgacgccuuacagcaucccuacaucaacgucugguaugacccagccgaaguggaggcgccuccaccucagauauaugacaagcaguuggaugaaagagaacacacaauugaagaauggaaagaacuuaucuacaaggaaguaaugaauucagaagaaaagacuaaaaaugguguaguaaaaggacagccuucuccuucagcacaggugcagcagugaacagcagugagagucucccuccauccucgucugucaaugacaucuccuccauguccaccgaccagacccuggcaucugacacugacagcagccuggaagccucggcaggaccccuggguuguugcaggugacuagccgccugccugcgaaacccagcguucuucaggagaugaugugauggaacacacacacacgcagacacacacacacacacaaaugcagacacacaacaucaagaaaacagcaagggagagaauccaagccuaaaauuaaauaaaucuuucagccugcuucuuccccaggguucuguauugcagcuaagcucaaauguauauuuaacuucuaguugcucuugcuuuggucuucuuccaaugaugcuuacuacagaaagcaaaucagacacaauuagagaagccuuuuccauaaaguguaauuuuaauggcugcaaaaccggcaaccuguaacugcccuuuuaaauggcaugacaaggugugcaguggccccauccagcaugugugugucucuaucuugcaucuaccugcuccuuggccuagucagauggauguagauacagauccgcaugugucuguauucauacagcacuacuuacuuagagaugcuacugucaguguccucagggcucuaccaagacauaaugcacugggguaccacaugguccauuucaugugaucuauuacucugacauaaacccaucuguaauauauugccaguauauaagcuguuuaguuuguuaauugauuaaacuguaugucuuauaagaaaacauguaaagggggaauauauggggggagugagcucucucagacccuugaagauguagcuuccaaauuugaauggauuaaauggcaccuguauaccaauuuguagaaagaacauaugugauacuuauguaaaguguggggcgaguggguaacaguuuucaggcacaaaaugguuuggccuucugaaggcaggugugaauaaaagcugagagucuuuucugugacaguaaagaguaggagagacuggaggguagugugugguguggacuaagacugaaaggagguuauuacccagauacuaggagacacuggugucccuguuuuagagauuuggcucuauacccauuugucauuucucaauuacuggucacaacaagaggccacuggagaaaguggcagguggugaagcaagguuauugugugugcuuuugaugauaagaaucucucucuggaacugagcagaauugccuccaugugaauuccuucaacaaaaaaaugagccugccuagacuacuuucagauuguggauuguguuuuccaugugugggcugcuucccugauucauacucugccaaaguuuuauuuugagaaauaauauuacuuuccucuucugaaauaaaauaauaauaauaauaaugaaacccccaaaccacagugugagucucagguuagcauuugaaaacaucuccagagacauuguuauuccucaggaguuucccugacuccuuaauguggcugauguuucauguuuauuuauuuauuuuaauaaguaugagcaaucgaagggcugaucaucugaguuuuguacugcaguagauguaagagcaauaacucugcccauaaauuuacugcugccaaauaguuuuagcaauaugaguuugucuuaaaagccaugaagcauuaaugucaauguuuagcaaaaucuccagaauuuagcuuaaauuaaauuaaaugaaagugcuuuccugagcacuuaaggaggcacugugaaacaucuugguuauguacaaggcaauaccaaggugaucucagcaauaaucaggcuucccuucuuauucacuucgaaguauccaucacaguuauuugcacucugaccauguuggugcucacuagaguggugauauuucaccugaagaagugaaagacaggaaguggaugguugaugagugugaacugauuggcaaauagaauauccccaaaacagagcaaacaagaaugccagugcucugaaaacugccuuaaauauaauaauagggaacuuucuuucucucuucaagcaauagagaccacagggaacugcacccaccugcaccaucgccaugccaguggugcugccauucugagauuauuucacacagucagauucaguacacgcagucauuuguuuaaaauaaauagaagaacauuccuuugugcagcuuguccccuggaauaaaaauggcccauuuucucua

SEQ ID NO: 44 - RNA, 4186 nt, Homo_Sapiens
uucaccggaaaacacaguagcuguagcugcacauagacgcuuccucuuucuguuucccccucaucccccucccuagaccucucugggcuuugacgucaugugugcuccuuucgguugccauagcaaccccauuccccaagcccucuguccgucuccucugguagguuccacaaugguacaggcagcaucacgcugcacaaugguuuccaggcagugaaagagggugauucagcaagccacucuucuucuauuuucuuuaaccuccccuucacuuuuuauuuuuauggggguggguggugcuugcuauaugcuuaccuuuuucuuuucuuuuuucauuuuuacaaauuuccuuuuuuguccucaccccucaauuccuaggggcuugagugaguuuaagauuggguuuucuuggaaaucaccuguccaucguuaauuuuaaacaaucuccauaucuccaaagaaucucuuccauguuagucuggaaugugguuaaugaaaaacaaguagggaggauuucuggggcaaacacugccggaucaggaucguaguucucaggcacggaauggcuagugugagaaacaccaacagcaggcccaucucagaucuucacuauggcaacuuaugcaagaaacuguugaauuagacccguuuccuauagaugagaaaccauacaagcugugguauuuaugagccuccauuucuuauacuacugcagugaaccaacauuggaugugaaaauugccuuuugucagggauucgauaaacaaguggaugugucauauauugccaaacauuacaacaugagcaaaagcaaaguugacaaccaguucuacaguguggaagugggagacucaaccuucacaguucucaagcgcuaccagaaucuaaagccuauuggcucuggggcucagggcauaguuugugccgcguaugaugcuguccuugacagaaauguggccauuaagaagcucagcagacccuuucagaaccaaacacaugccaagagagcguaccgggagcugguccucaugaagugugugaaccauaaaaacauuauuaguuuauuaaaugucuucacaccccagaaaacgcuggaggaguuccaagauguuuacuuaguaauggaacugauggaugccaacuuaugucaagugauucagauggaauuagaccaugagcgaaugucuuaccugcuguaccaaauguuguguggcauuaagcaccuccauucugcuggaauuauucacagggauuuaaaaccaaguaacauuguagucaagucugauugcacauugaaaauccuggacuuuggacuggccaggacagcaggcacaagcuucaugaugacuccauauguggugacacguuauuacagagccccugaggucauccuggggaugggcuacaaggagaacguggauauauggucugugggaugcauuaugggagaaaugguucgccacaaaauccucuuuccaggaagggacuauauugaccaguggaauaagguaauugaacaacuaggaacaccauguccagaauucaugaagaaauugcaacccacaguaagaaacuauguggagaaucggcccaaguaugcgggacucaccuuccccaaacucuucccagauucccucuucccagcggacuccgagcacaauaaacucaaagccagccaagccagggacuuguugucaaagaugcuagugauugacccagcaaaaagaauaucaguggacgacgccuuacagcaucccuacaucaacgucugguaugacccagccgaaguggaggcgccuccaccucagauauaugacaagcaguuggaugaaagagaacacacaauugaagaauggaaagaacuuaucuacaaggaaguaaugaauucagaagaaaagacuaaaaaugguguaguaaaaggacagccuucuccuucaggugcagcagugaacagcagugagagucucccuccauccucgucugucaaugacaucuccuccauguccaccgaccagacccuggcaucugacacugacagcagccuggaagccucggcaggaccccuggguuguugcaggugacuagccgccugccugcgaaacccagcguucuucaggagaugaugugauggaacacacacacacgcagacacacacacacacacaaaugcagacacacaacaucaagaaaacagcaagggagagaauccaagccuaaaauuaaauaaaucuuucagccugcuucuuccccaggguucuguauugcagcuaagcucaaauguauauuuaacuucuaguugcucuugcuuuggucuucuuccaaugaugcuuacuacagaaagcaaaucagacacaauuagagaagccuuuuccauaaaguguaauuuuaauggcugcaaaaccggcaaccuguaacugcccuuuuaaauggcaugacaaggugugcaguggccccauccagcaugugugugucucuaucuugcaucuaccugcuccuuggccuagucagauggauguagauacagauccgcaugugucuguauucauacagcacuacuuacuuagagaugcuacugucaguguccucagggcucuaccaagacauaaugcacugggguaccacaugguccauuucaugugaucuauuacucugacauaaacccaucuguaauauauugccaguauauaagcuguuuaguuuguuaauugauuaaacuguaugucuuauaagaaaacauguaaagggggaauauauggggggagugagcucucucagacccuugaagauguagcuuccaaauuugaauggauuaaauggcaccuguauaccaauuuguagaaagaacauaugugauacuuauguaaaguguggggcgaguggguaacaguuuucaggcacaaaaugguuuggccuucugaaggcaggugugaauaaaagcugagagucuuuucugugacaguaaagaguaggagagacuggaggguagugugugguguggacuaagacugaaaggagguuauuacccagauacuaggagacacuggugucccuguuuuagagauuuggcucuauacccauuugucauuucucaauuacuggucacaacaagaggccacuggagaaaguggcagguggugaagcaagguuauugugugugcuuuugaugauaagaaucucucucuggaacugagcagaauugccuccaugugaauuccuucaacaaaaaaaugagccugccuagacuacuuucagauuguggauuguguuuuccaugugugggcugcuucccugauucauacucugccaaaguuuuauuuugagaaauaauauuacuuuccucuucugaaauaaaauaauaauaauaauaaugaaacccccaaaccacagugugagucucagguuagcauuugaaaacaucuccagagacauuguuauuccucaggaguuucccugacuccuuaauguggcugauguuucauguuuauuuauuuauuuuaauaaguaugagcaaucgaagggcugaucaucugaguuuuguacugcaguagauguaagagcaauaacucugcccauaaauuuacugcugccaaauaguuuuagcaauaugaguuugucuuaaaagccaugaagcauuaaugucaauguuuagcaaaaucuccagaauuuagcuuaaauuaaauuaaaugaaagugcuuuccugagcacuuaaggaggcacugugaaacaucuugguuauguacaaggcaauaccaaggugaucucagcaauaaucaggcuucccuucuuauucacuucgaaguauccaucacaguuauuugcacucugaccauguuggugcucacuagaguggugauauuucaccugaagaagugaaagacaggaaguggaugguugaugagugugaacugauuggcaaauagaauauccccaaaacagagcaaacaagaaugccagugcucugaaaacugccuuaaauauaauaauagggaacuuucuuucucucuucaagcaauagagaccacagggaacugcacccaccugcaccaucgccaugccaguggugcugccauucugagauuauuucacacagucagauucaguacacgcagucauuuguuuaaaauaaauagaagaacauuccuuugugcagcuuguccccuggaauaaaaauggcccauuuucucua

SEQ ID NO: 45 - RNA, 4213 nt, Homo_Sapiens
uucaccggaaaacacaguagcuguagcugcacauagacgcuuccucuuucuguuucccccucaucccccucccuagaccucucugggcuuugacgucaugugugcuccuuucgguugccauagcaaccccauuccccaagcccucuguccgucuccucugguagguuccacaaugguacaggcagcaucacgcugcacaaugguuuccaggcagugaaagagggugauucagcaagccacucuucuucuauuuucuuuaaccuccccuucacuuuuuauuuuuauggggguggguggugcuugcuauaugcuuaccuuuuucuuuucuuuuuucauuuuuacaaauuuccuuuuuuguccucaccccucaauuccuaggggcuugagugaguuuaagauuggguuuucuuggaaaucaccuguccaucguuaauuuuaaacaaucuccauaucuccaaagaaucucuuccauguuagucuggaaugugguuaaugaaaaacaaguagggaggauuucuggggcaaacacugccggaucaggaucguaguucucaggcacggaauggcuagugugagaaacaccaacagcaggcccaucucagaucuucacuauggcaacuuaugcaagaaacuguugaauuagacccguuuccuauagaugagaaaccauacaagcugugguauuuaugagccuccauuucuuauacuacugcagugaaccaacauuggaugugaaaauugccuuuugucagguguguguuccuuacagguaaaacaagggauucgauaaacaaguggaugugucauauauugccaaacauuacaacaugagcaaaagcaaaguugacaaccaguucuacaguguggaagugggagacucaaccuucacaguucucaagcgcuaccagaaucuaaagccuauuggcucuggggcucagggcauaguuugugccgcguaugaugcuguccuugacagaaauguggccauuaagaagcucagcagacccuuucagaaccaaacacaugccaagagagcguaccgggagcugguccucaugaagugugugaaccauaaaaacauuauuaguuuauuaaaugucuucacaccccagaaaacgcuggaggaguuccaagauguuuacuuaguaauggaacugauggaugccaacuuaugucaagugauucagauggaauuagaccaugagcgaaugucuuaccugcuguaccaaauguuguguggcauuaagcaccuccauucugcuggaauuauucacagggauuuaaaaccaaguaacauuguagucaagucugauugcacauugaaaauccuggacuuuggacuggccaggacagcaggcacaagcuucaugaugacuccauauguggugacacguuauuacagagccccugaggucauccuggggaugggcuacaaggagaacguggauauauggucugugggaugcauuaugggagaaaugguucgccacaaaauccucuuuccaggaagggacuauauugaccaguggaauaagguaauugaacaacuaggaacaccauguccagaauucaugaagaaauugcaacccacaguaagaaacuauguggagaaucggcccaaguaugcgggacucaccuuccccaaacucuucccagauucccucuucccagcggacuccgagcacaauaaacucaaagccagccaagccagggacuuguugucaaagaugcuagugauugacccagcaaaaagaauaucaguggacgacgccuuacagcaucccuacaucaacgucugguaugacccagccgaaguggaggcgccuccaccucagauauaugacaagcaguuggaugaaagagaacacacaauugaagaauggaaagaacuuaucuacaaggaaguaaugaauucagaagaaaagacuaaaaaugguguaguaaaaggacagccuucuccuucaggugcagcagugaacagcagugagagucucccuccauccucgucugucaaugacaucuccuccauguccaccgaccagacccuggcaucugacacugacagcagccuggaagccucggcaggaccccuggguuguugcaggugacuagccgccugccugcgaaacccagcguucuucaggagaugaugugauggaacacacacacacgcagacacacacacacacacaaaugcagacacacaacaucaagaaaacagcaagggagagaauccaagccuaaaauuaaauaaaucuuucagccugcuucuuccccaggguucuguauugcagcuaagcucaaauguauauuuaacuucuaguugcucuugcuuuggucuucuuccaaugaugcuuacuacagaaagcaaaucagacacaauuagagaagccuuuuccauaaaguguaauuuuaauggcugcaaaaccggcaaccuguaacugcccuuuuaaauggcaugacaaggugugcaguggccccauccagcaugugugugucucuaucuugcaucuaccugcuccuuggccuagucagauggauguagauacagauccgcaugugucuguauucauacagcacuacuuacuuagagaugcuacugucaguguccucagggcucuaccaagacauaaugcacugggguaccacaugguccauuucaugugaucuauuacucugacauaaacccaucuguaauauauugccaguauauaagcuguuuaguuuguuaauugauuaaacuguaugucuuauaagaaaacauguaaagggggaauauauggggggagugagcucucucagacccuugaagauguagcuuccaaauuugaauggauuaaauggcaccuguauaccaauuuguagaaagaacauaugugauacuuauguaaaguguggggcgaguggguaacaguuuucaggcacaaaaugguuuggccuucugaaggcaggugugaauaaaagcugagagucuuuucugugacaguaaagaguaggagagacuggaggguagugugugguguggacuaagacugaaaggagguuauuacccagauacuaggagacacuggugucccuguuuuagagauuuggcucuauacccauuugucauuucucaauuacuggucacaacaagaggccacuggagaaaguggcagguggugaagcaagguuauugugugugcuuuugaugauaagaaucucucucuggaacugagcagaauugccuccaugugaauuccuucaacaaaaaaaugagccugccuagacuacuuucagauuguggauuguguuuuccaugugugggcugcuucccugauucauacucugccaaaguuuuauuuugagaaauaauauuacuuuccucuucugaaauaaaauaauaauaauaauaaugaaacccccaaaccacagugugagucucagguuagcauuugaaaacaucuccagagacauuguuauuccucaggaguuucccugacuccuuaauguggcugauguuucauguuuauuuauuuauuuuaauaaguaugagcaaucgaagggcugaucaucugaguuuuguacugcaguagauguaagagcaauaacucugcccauaaauuuacugcugccaaauaguuuuagcaauaugaguuugucuuaaaagccaugaagcauuaaugucaauguuuagcaaaaucuccagaauuuagcuuaaauuaaauuaaaugaaagugcuuuccugagcacuuaaggaggcacugugaaacaucuugguuauguacaaggcaauaccaaggugaucucagcaauaaucaggcuucccuucuuauucacuucgaaguauccaucacaguuauuugcacucugaccauguuggugcucacuagaguggugauauuucaccugaagaagugaaagacaggaaguggaugguugaugagugugaacugauuggcaaauagaauauccccaaaacagagcaaacaagaaugccagugcucugaaaacugccuuaaauauaauaauagggaacuuucuuucucucuucaagcaauagagaccacagggaacugcacccaccugcaccaucgccaugccaguggugcugccauucugagauuauuucacacagucagauucaguacacgcagucauuuguuuaaaauaaauagaagaacauuccuuugugcagcuuguccccuggaauaaaaauggcccauuuucucua

SEQ ID NO: 46 - RNA, 3511 nt, Homo_Sapiens
aauuauaugcuauauucuuggcaagaucuuuuucuucuccuuugcccucuucuacuccuuccccccuucuccuguuucuccuucuucccuuccuccaacucuucuucauccuccuagcauguagaauauucuuaugccagucacucauaucuuuacuuaaagccugauuggcaugugaccagaguagacaguaucuaagauuccgaaauagcauuuucuuuaccaguauccuuaaucaaguaggcaagaguucuaaggaaucuuuuguucuuaauucugaguugcucuuggaucucuacagugccgcguaugaugcuguccuugacagaaauguggccauuaagaagcucagcagacccuuucagaaccaaacacaugccaagagagcguaccgggagcugguccucaugaagugugugaaccauaaaaacuuacuuaguaauggaacugauggaugccaacuuaugucaagugauucagauggaauuagaccaugagcgaaugucuuaccugcuguaccaaauguuguguggcauuaagcaccuccauucugcuggaauuauucacagggauuuaaaaccaaguaacauuguagucaagucugauugcacauugaaaauccuggacuuuggacuggccaggacagcaggcacaagcuucaugaugacuccauauguggugacacguuauuacagagccccugaggucauccuggggaugggcuacaaggagaacguggauauauggucugugggaugcauuaugggagaaaugguucgccacaaaauccucuuuccaggaagggacuauauugaccaguggaauaagguaauugaacaacuaggaacaccauguccagaauucaugaagaaauugcaacccacaguaagaaacuauguggagaaucggcccaaguaugcgggacucaccuuccccaaacucuucccagauucccucuucccagcggacuccgagcacaauaaacucaaagccagccaagccagggacuuguugucaaagaugcuagugauugacccagcaaaaagaauaucaguggacgacgccuuacagcaucccuacaucaacgucugguaugacccagccgaaguggaggcgccuccaccucagauauaugacaagcaguuggaugaaagagaacacacaauugaagaauggaaagaacuuaucuacaaggaaguaaugaauucagaagaaaagacuaaaaaugguguaguaaaaggacagccuucuccuucagcacaggugcagcagugaacagcagugagagucucccuccauccucgucugucaaugacaucuccuccauguccaccgaccagacccuggcaucugacacugacagcagccuggaagccucggcaggaccccuggguuguugcaggugacuagccgccugccugcgaaacccagcguucuucaggagaugaugugauggaacacacacacacgcagacacacacacacacacaaaugcagacacacaacaucaagaaaacagcaagggagagaauccaagccuaaaauuaaauaaaucuuucagccugcuucuuccccaggguucuguauugcagcuaagcucaaauguauauuuaacuucuaguugcucuugcuuuggucuucuuccaaugaugcuuacuacagaaagcaaaucagacacaauuagagaagccuuuuccauaaaguguaauuuuaauggcugcaaaaccggcaaccuguaacugcccuuuuaaauggcaugacaaggugugcaguggccccauccagcaugugugugucucuaucuugcaucuaccugcuccuuggccuagucagauggauguagauacagauccgcaugugucuguauucauacagcacuacuuacuuagagaugcuacugucaguguccucagggcucuaccaagacauaaugcacugggguaccacaugguccauuucaugugaucuauuacucugacauaaacccaucuguaauauauugccaguauauaagcuguuuaguuuguuaauugauuaaacuguaugucuuauaagaaaacauguaaagggggaauauauggggggagugagcucucucagacccuugaagauguagcuuccaaauuugaauggauuaaauggcaccuguauaccaauuuguagaaagaacauaugugauacuuauguaaaguguggggcgaguggguaacaguuuucaggcacaaaaugguuuggccuucugaaggcaggugugaauaaaagcugagagucuuuucugugacaguaaagaguaggagagacuggaggguagugugugguguggacuaagacugaaaggagguuauuacccagauacuaggagacacuggugucccuguuuuagagauuuggcucuauacccauuugucauuucucaauuacuggucacaacaagaggccacuggagaaaguggcagguggugaagcaagguuauugugugugcuuuugaugauaagaaucucucucuggaacugagcagaauugccuccaugugaauuccuucaacaaaaaaaugagccugccuagacuacuuucagauuguggauuguguuuuccaugugugggcugcuucccugauucauacucugccaaaguuuuauuuugagaaauaauauuacuuuccucuucugaaauaaaauaauaauaauaauaaugaaacccccaaaccacagugugagucucagguuagcauuugaaaacaucuccagagacauuguuauuccucaggaguuucccugacuccuuaauguggcugauguuucauguuuauuuauuuauuuuaauaaguaugagcaaucgaagggcugaucaucugaguuuuguacugcaguagauguaagagcaauaacucugcccauaaauuuacugcugccaaauaguuuuagcaauaugaguuugucuuaaaagccaugaagcauuaaugucaauguuuagcaaaaucuccagaauuuagcuuaaauuaaauuaaaugaaagugcuuuccugagcacuuaaggaggcacugugaaacaucuugguuauguacaaggcaauaccaaggugaucucagcaauaaucaggcuucccuucuuauucacuucgaaguauccaucacaguuauuugcacucugaccauguuggugcucacuagaguggugauauuucaccugaagaagugaaagacaggaaguggaugguugaugagugugaacugauuggcaaauagaauauccccaaaacagagcaaacaagaaugccagugcucugaaaacugccuuaaauauaauaauagggaacuuucuuucucucuucaagcaauagagaccacagggaacugcacccaccugcaccaucgccaugccaguggugcugccauucugagauuauuucacacagucagauucaguacacgcagucauuuguuuaaaauaaauagaagaacauuccuuugugcagcuuguccccuggaauaaaaauggcccauuuucucua

SEQ ID NO: 47 - RNA, 7126 nt, Homo_Sapiens
agagcggcucuuuuaaugaggguugcgacgucucccuccccacacccauaaaccagucggguuggacgucacugcuaauucguuucagugaugauaggauaaaggagggacauuaagaaauaaauucccccucacgacccucgcugagcucacggcucagucccuacauauuuaugccgcguuuccagccgcugggugaggagcuacuuagcgccgcggcuccuccgaggggcggccgggcagcgagcagcggccgagcggacgggcucaugaugccucagaucugauccgcaucuaacaggcuggcaaugaagauacccagagaauaguucacaucuaucaugcgucacuucuagacacagccaucagacgcaucuccuccccuuucugccugaccuuagggacacgucccaccgccucucuugacgucugccuggucaaccaucacuuccuuagagaauaaggagagaggcggaugcaggaaaucaugccaccgacgggccaccagccaugagugggugacgcugagcugacgucaaagacagagagggcugaagccuugucagcaccugucaccccggcuccugcucuccguguagccugaagccuggauccuccuggugaaaucaucuuggccugauagcauugugaggucuucagacaggaccccucggaagcuaguuaccauggaggaucacauguucgguguucagcaaauccagcccaaugucauuucuguucgucucuucaagcgcaaaguugggggccugggauuucuggugaaggagcgggucaguaagccgcccgugaucaucucugaccugauucgugggggcgccgcagagcagaguggccucauccaggccggagacaucauucuugcggucaacggccggcccuugguggaccugagcuaugacagcgcccuggagguacucagaggcauugccucugagacccacgugguccucauucugaggggcccugaagguuucaccacgcaccuggagaccaccuuuacaggugaugggacccccaagaccauccgggugacacagccccuggguccccccaccaaagccguggaucugucccaccagccaccggccggcaaagaacagccccuggcaguggauggggccucgggucccgggaaugggccucagcaugccuacgaugaugggcaggaggcuggcucacucccccaugccaacggccuggcccccaggcccccaggccaggaccccgcgaagaaagcaaccagagucagccuccaaggcagaggggagaacaaugaacugcucaaggagauagagccugugcugagccuucucaccagugggagcagaggggucaagggaggggcaccugccaaggcagagaugaaagauaugggaauccagguggacagagauuuggacggcaagucacacaaaccucugccccucggcguggagaacgaccgagucuucaaugaccuaugggggaagggcaaugugccugucguccucaacaacccauauucagagaaggagcagccccccaccucaggaaaacagucccccacaaagaauggcagccccuccaaguguccacgcuuccucaaggucaagaacugggagacugaggugguucucacugacacccuccaccuuaagagcacauuggaaacgggaugcacugaguacaucugcaugggcuccaucaugcauccuucucagcaugcaaggaggccugaagacguccgcacaaaaggacagcucuucccucucgccaaagaguuuauugaucaauacuauucaucaauuaaaagauuuggcuccaaagcccacauggaaaggcuggaagaggugaacaaagagaucgacaccacuagcacuuaccagcucaaggacacagagcucaucuauggggccaagcacgccuggcggaaugccucgcgcugugugggcaggauccagugguccaagcugcagguauucgaugcccgugacugcaccacggcccacgggauguucaacuacaucuguaaccaugucaaguaugccaccaacaaagggaaccucaggucugccaucaccauauucccccagaggacagacggcaagcacgacuuccgagucuggaacucccagcucauccgcuacgcuggcuacaagcagccugacggcuccacccugggggacccagccaaugugcaguucacagagauaugcauacagcagggcuggaaaccgccuagaggccgcuucgauguccugccgcuccugcuucaggccaacggcaaugacccugagcucuuccagauuccuccagagcugguguuggaaguucccaucaggcaccccaaguuugagugguucaaggaccuggggcugaagugguacggccuccccgccguguccaacaugcuccuagagauuggcggccuggaguucagcgccugucccuucaguggcugguacaugggcacagagauugguguccgcgacuacugugacaacucccgcuacaauauccuggaggaaguggccaagaagaugaacuuagacaugaggaagacguccucccuguggaaggaccaggcgcugguggagaucaauaucgcgguucucuauagcuuccagagugacaaagugaccauuguugaccaucacuccgccaccgaguccuucauuaagcacauggagaaugaguaccgcugccgggggggcugcccugccgacuggguguggaucgugccccccauguccggaagcaucaccccuguguuccaccaggagaugcucaacuaccggcucacccccuccuucgaauaccagccugaucccuggaacacgcaugucuggaaaggcaccaacgggacccccacaaagcggcgagccauuggcuucaagaagcuagcagaagcugucaaguucucggccaagcugauggggcaggcuauggccaagagggugaaagcgaccauccucuaugccacagagacaggcaaaucgcaagcuuaugccaagaccuugugugagaucuucaaacacgccuuugaugccaaggugauguccauggaagaauaugacauugugcaccuggaacaugaaacucugguccuuguggucaccagcaccuuuggcaauggagaucccccugagaauggggagaaauucggcugugcuuugauggaaaugaggcaccccaacucugugcaggaagaaaggaagagcuacaagguccgauucaacagcgucuccuccuacucugacucccaaaaaucaucaggcgaugggcccgaccucagagacaacuuugagagugcuggaccccuggccaaugugagguucucaguuuuuggccucggcucacgagcauacccucacuuuugcgccuucggacacgcuguggacacccuccuggaagaacugggaggggagaggauccugaagaugagggaaggggaugagcucugugggcaggaagaggcuuucaggaccugggccaagaaggucuucaaggcagccugugaugucuucugugugggagaugaugucaacauugaaaaggccaacaauucccucaucagcaaugaucgcagcuggaagagaaacaaguuccgccucaccuuuguggccgaagcuccagaacucacacaaggucuauccaauguccacaaaaagcgagucucagcugcccggcuccuuagccgucaaaaccuccagagcccuaaauccagucggucaacuaucuucgugcgucuccacaccaacgggagccaggagcugcaguaccagccuggggaccaccugggugucuucccuggcaaccacgaggaccucgugaaugcccugaucgagcggcuggaggacgcgccgccugucaaccagauggugaaaguggaacugcuggaggagcggaacacggcuuuaggugucaucaguaacuggacagacgagcuccgccucccgcccugcaccaucuuccaggccuucaaguacuaccuggacaucaccacgccaccaacgccucugcagcugcagcaguuugccucccuagcuaccagcgagaaggagaagcagcgucugcugguccucagcaaggguuugcaggaguacgaggaauggaaauggggcaagaaccccaccaucguggaggugcuggaggaguucccaucuauccagaugccggccacccugcuccugacccagcugucccugcugcagccccgcuacuauuccaucagcuccuccccagacauguacccugaugaagugcaccucacuguggccaucguuuccuaccgcacucgagauggagaaggaccaauucaccacggcguaugcuccuccuggcucaaccggauacaggcugacgaacugguccccuguuucgugagaggagcacccagcuuccaccugccccggaacccccaaguccccugcauccucguuggaccaggcaccggcauugccccuuuccgaagcuucuggcaacagcggcaauuugauauccaacacaaaggaaugaaccccugccccaugguccuggucuucgggugccggcaauccaagauagaucauaucuacagggaagagacccugcaggccaagaacaagggggucuucagagagcuguacacggcuuacucccgggagccagacaaaccaaagaaguacgugcaggacauccugcaggagcagcuggcggagucuguguaccgagcccugaaggagcaagggggccacauauacgucuguggggacgucaccauggcugcugauguccucaaagccauccagcgcaucaugacccagcaggggaagcucucggcagaggacgccggcguauucaucagccggaugagggaugacaaccgauaccaugaggauauuuuuggagucacccugcgaacguacgaagugaccaaccgccuuagaucugaguccauugccuucauugaagagagcaaaaaagacaccgaugagguuuucagcuccuaacuggacccucuugcccagccggcugcaaguuuuguaagcgcggacagacacugcugaaccuuuccucugggacccccuguggcccucgcucugccuccuguccuugucgcugugcccugguuucccuccucgggcuucucgccccucagugguuuccucggcccuccuggguuuacuccuugaguuuuccugcugcgaugcaaugcuuuucuaaucugcaguggcucuuacaaaacucuguucccacucccucucuugccgacaagggcaacucacgggugcaugaaaccacuggaacauggccgucgcuguggggguuuuuuucucugggguuccccuggaaaggcugcaggaacuaggcacaagcucucugagccagucccucagccacugaagucccccuuucuccuuuuuuaugaugacauuuugguugugcgugccugugugugugugugugugugugugugugugugugaugggccaggucucuguccguccucuucccugcacaagugugucgaucuuagauugccacugcuuucauugaagacccucaaugccaagaaacgugucccuggcccauauuaaucccucguguguccauaauuaggguccacgcccauguaccugaaacauuuggaagccccauaauuguucuaguuagaaaggguucagggcauggggagaggagugggaaauugauuaaaggggcugucucccaaugaaagaggcauucccagaauuugcugcauuuagauuuugauaccagugagcagagcccucaugugacaugaacccauccaauggauugugcaaauccccuccccaaacccacccauaccagcuagaaucacuugacuuugccacauccauugacugacccccuccuccagcaauagcauccaaggggccuggaaguuauguuguucaaagaagccugguggcaauaaggaucuucccacuuugccacuggaugacuuuggaugggucacuuguccucaguuuuuccuagucauaaugucauacgaaccuaaagaauaugaauggauuaaauguuaaagcuuuggugccuggaaacaauaucaaguaacaauaugauuauuauuuuuuuauucccccaaagcgggcuugcugcuucacccuuggggaugaaauaauggaagcugguuaaaguggaugagguuggaaagaguugccauaaugaggucccacguggcuucuucgauaggagccacaacuuggggugggaagaacuugucccucaggcuuguugcccucugcaguugaucuccaaaguuuuaaaccuguuaaauuaauuuugacaaauaaguuacccucaacucagaucaaaaaugggcagccaagucuucgguaggaauuggagccgguguaauuccucccuaagaggcaaccuguugaauuuacucucucagaguaaauggugggaagggaucccuuuguauacuuuuuuaaauacuacaaauuagugucaggcaguucccagaaagagacaagaaauccuaguggccucccagacugcaggguccccaaggauggaaagggaauguucugcugguucuacccuguuuguugugucuugcuauacagaaaaaccacauuucuuuuauauacuguacgugggcauaucuuguuguucaguuugggugucugcuaaagaggaagugcacuggcccucuuugaaagggcuuuacagugggggcaccaagaccccaaagggcccaggccaggagacuguuaaagugaaaaggcaaucuaugacucaccuugcucugccaucccuggcagcccccaccgguguccuguuccugccacauggagcuugacuucaugccagcuauaaucuccccugccuuccuuuaaucccaauuuccccugcucacucuuccacagauauaaagaacaaacacuuagcaucccacacucaccccuucuaauccugaagggaagcccauucuaaacuccuuuccugcaaacccauuuccagcuccuaguagcuuuccucccaaaggcuuucuuuccaauccuuuauagcuuuggagacgccuccccaauuccccagggaaggaaacuguuguguccaauccccauuaaagacaaauugaucagugcuuccc

SEQ ID NO: 48 - RNA, 2738 nt, Homo_Sapiens
agagugccgagcagcgcggugggugcggcugugagacggcaggagacuucugccccgcggugcacgcgacccucgagacgacagcgcggcuacugccagcagcgaaggcgccucccgcggagcgccccgacggcgcccgcucgcccaugccgagcugagcgcggcagcggcggcgggaugcuggcgcugcuggccgccagcguggcgcucgccguggccgcuggggcccaggacagcccggcgcccgguagccgcuucgugugcacggcacugcccccagaggcggugcacgccggcugcccgcugcccgcgaugcccaugcagggcggcgcgcagagucccgaggaggagcugagggccgcggugcugcagcugcgcgagaccgucgugcagcagaaggagacgcugggcgcgcagcgcgaggccauccgcgagcucacgggcaagcuagcgcgcugcgaggggcuggcgggcggcaaggcgcgcggcgcgggggccacgggcaaggacacuaugggcgaccugccgcgggaccccggccacgucguggagcagcucagccgcucgcugcagacccucaaggaccgccuggagagccucgagcaccagcucagagcaaacguguccaaugcugggcugcccggcgacuuccgcgaggugcuccagcagcggcugggggagcuggagaggcagcuucugcgcaagguggcagagcuggaggacgagaagucccugcugcacaaugagaccucggcucaccggcagaagaccgagagcacccugaacgcgcugcugcagagggucaccgagcuggagcgaggcaauagcgccuuuaagucaccagaugcguucaaggugucccucccacuccgcacaaacuaccuauacggcaagaucaagaagacgcugccugagcuguacgccuucaccaucugccuguggcugcgguccagcgccucaccaggcauuggcacccccuucuccuaugcggugccagggcaggccaacgagaucgugcugaucgaguggggcaacaaccccaucgagcugcucaucaacgacaagguugcgcagcugccccuguuugucagugacggcaaguggcaccacaucugugucaccuggacgacacgggauggcaugugggaggcauuccaggacggagagaagcugggcacuggggagaaccuggcccccuggcaccccaucaagcccgggggcgugcugauccuuggacaagagcaggacaccgugggggguagguuugaugccacucaggcauuugucggggagcucagccaguucaacauaugggaccgcguccuucgcgcacaagaaauugucaacaucgccaacugcuccacaaacaugccgggcaacaucaucccguggguggacaauaacgucgauguguucggaggggccuccaaguggcccguggagacgugugaggagcgucuccuugacuuguagccgccuucuccucuguccaggaggccgggaucaggcuguugccauggaaguucagggccauagacugccccacuuaaacucuugucagucugggcucaggguucccagagcucauuccccaggaaucucuaagaccagggcuggggcagugucugucacuggcuuguuuguucccuaccaauauucuguugcuguuugaaguagugccaggguccccugggaagaugcccccaagacaccugccccaaguggguggauaucugccuuccugcugcaaguggaggcagguccagcagccccucuucagagccccuguaaaugcuaucgcagccugaguccugccgccuuccaguuccuuggugucccgugcaccccuucugucuguccccuuucauggcugugcagccgucccgcuggaguggccaugucccuugugcauugagugcauccccgcuggugacuaagcucgcagcaagcggcuaccccccgaucugcaaaagggccucucccuuuguguucuauacauugugaaucuucccgucugaagaacgcccagccugcccagacaaagccccgccuuccccaaagcagaggggcugucugugucuccagaaaggggacaucgggggggaggggggcucagaaaggagaagggcugugaucuccggucccuucccccaucauccuuccuuagacugaugcuuugacugaaucaucacuagcuauggcauuaaaaggccucucuucucaucuggugccaaagguuccguugcagcuuuuuacaaccauccggugugguuuggaggauuuguuuuuuuuuuuucccaacagaaaagaacagccauuagaagaaggcucccauuuucugauguuccgccccacugugaagagugugcucguuuuaaauucauguugauucuuguaagcacuggacugucuucaucaaguauuucccuacagaacuccucaagaaaacagagaucauuuggcuagagauugucugagugacuccaagcuacucacuguauuggacgggaguaguaauuuauuuuaaagauaaagugacuaaguggggaaauuuauaaagcuaaauauuauauauuuuauuuuucauacauguuugaagugcaaaucuguggauauuccauuuguaggaccaagucgacaugcccauccugacauuguaugcuacgagaacucuucugaugauggaauuucgauuaaagugcacugaaagaugaaaaaaaaaaaaaaaaaaaaaaaaa

SEQ ID NO: 49 - RNA, 1235 nt, Homo_Sapiens
gagcgcgggagaccggacccgagagcagagcugcuguuucggcgcgggucggcuggcggccgacugccccagagcccccacccggcaccacacagaccccacccccgcccugcgccagccuucguccccgcagaggaccccccgacaccagcauggacugcugcaccgagaacgccugcuccaagccggacgacgacauucuagacaucccgcuggacgaucccggcgccaacgcggccgccgccaaaauccaggcgaguuuucggggccacauggcgcggaagaagauaaagagcggagagcgcggccggaagggcccgggcccuggggggccuggcggagcugggguggcccggggaggcgcgggcggcggccccagcggagacuaggccagaacugagcauuuucaaaguucccgaggagagauggaugccgcguccccuucgcagcgacgagacuucccugccguguuugugacccccuccugcccagcaaccugccagcuacaggagcccccugcgucccagagacucccucacccaggcaggcuccgucgcggagucgcugaguccgugcccuuuuaguuaguucugcagucuaguaugguccccauuugcccuuccacuccaccccacccuaaaccaugcgcucccaaucuuccuucuuuugcuucucgcccaccucuucccgcacccagcaugcagcucugccuccgcagccucagugcgcuuuccugcgcgcacugcggagggcgcccuaagcgucacccaagcacacucacuuaaagaaaaaacgaguucuuucguucugugcgcagcuaaaaggggcgcccuacaucuccgugccacucccgccccagccuagccccaagacuuuggauccggggcgagaugaagggaagaggguuguuuugguuucggacgacccuugcucugaccggaagagaagucccuaucccacaccugccugucacguucccuccccuuuccccagcgcacuguugagggcagccucuccagcucucuuguuuaugcaaacgccgagcgccugggaggcucgguaggaggagucuuccacggccccgccccgccccugucggucccgcccucccccccgccgggcuccuggggcuguggccgaaagguuucugaucuccgugugugcaugugacugugcuggguuggaaugugaacaauaaagaggaauguccaagugaaaaaaaaaaaaaaaaaaaa

SEQ ID NO: 50 - RNA, 1238 nt, Homo_Sapiens
gagcgcgggagaccggacccgagagcagagcugcuguuucggcgcgggucggcuggcggccgacugccccagagcccccacccggcaccacacagaccccacccccgcccugcgccagccuucguccccgcagaggaccccccgacaccagcauggacugcugcaccgagaacgccugcuccaagccggacgacgacauucuagacaucccgcuggacgaucccggcgccaacgcggccgccgccaaaauccaggcgaguuuucggggccacauggcgcggaagaagauaaagagcggagagcgcggccggaagggcccgggcccuggggggccuggcggagcugggguggcccggggaggcgcgggcggcggccccagcggagacuaggccagaagaacugagcauuuucaaaguucccgaggagagauggaugccgcguccccuucgcagcgacgagacuucccugccguguuugugacccccuccugcccagcaaccugccagcuacaggagcccccugcgucccagagacucccucacccaggcaggcuccgucgcggagucgcugaguccgugcccuuuuaguuaguucugcagucuaguaugguccccauuugcccuuccacuccaccccacccuaaaccaugcgcucccaaucuuccuucuuuugcuucucgcccaccucuucccgcacccagcaugcagcucugccuccgcagccucagugcgcuuuccugcgcgcacugcggagggcgcccuaagcgucacccaagcacacucacuuaaagaaaaaacgaguucuuucguucugugcgcagcuaaaaggggcgcccuacaucuccgugccacucccgccccagccuagccccaagacuuuggauccggggcgagaugaagggaagaggguuguuuugguuucggacgacccuugcucugaccggaagagaagucccuaucccacaccugccugucacguucccuccccuuuccccagcgcacuguugagggcagccucuccagcucucuuguuuaugcaaacgccgagcgccugggaggcucgguaggaggagucuuccacggccccgccccgccccugucggucccgcccucccccccgccgggcuccuggggcuguggccgaaagguuucugaucuccgugugugcaugugacugugcuggguuggaaugugaacaauaaagaggaauguccaagugaaaaaaaaaaaaaaaaaaaa

SEQ ID NO: 51 - RNA, 1241 nt, Homo_Sapiens
aguucacucacuuucaaagccagcugaaggaaagaggaagugcuagagagagcccccuucagugugcuucugacuuuuacggacuuggcuuguuagaaggcugaaagaugauggcaggaaugaaaauccagcuuguaugcaugcuacuccuggcuuucagcuccuggagucugugcucagauucagaagaggaaaugaaagcauuagaagcagauuucuugaccaauaugcauacaucaaagauuaguaaagcacauguucccucuuggaagaugacucugcuaaauguuugcagucuuguaaauaauuugaacagcccagcugaggaaacaggagaaguucaugaagaggagcuuguugcaagaaggaaacuuccuacugcuuuagauggcuuuagcuuggaagcaauguugacaauauaccagcuccacaaaaucugucacagcagggcuuuucaacacugggaguuaauccaggaagauauucuugauacuggaaaugacaaaaauggaaaggaagaagucauaaagagaaaaauuccuuauauucugaaacggcagcuguaugagaauaaacccagaagacccuacauacucaaaagagauucuuacuauuacugagagaauaaaucauuuauuuacaugugauugugauucaucaucccuuaauuaaauaucaaauuauauuugugugaaaaugugacaaacacacuuaucugucucuucuacaauugugguuuauugaaugugauuuuucugcacuaauauaaauuagacuaaguguuuucaaauaaaucuaaaucuucagcaugauguguuguguauaauuggaguagauauuaauuaagucaccuguauaauguuuuguaauuuugcaaaacauaucuugaguuguuuaaacagucaaaauguuugauauuuuauaccagcuuaugagcucaaaguacuacagcaaagccuagccugcauaucauucacccaaaacaaaguaauagcgccucuuuuauuauuuugacugaauguuuuauggaauugaaagaaacauacguucuuuucaagacuuccucaugaaucucucaauuauaggaaaaguuauugugauaaaauaggaacagcugaaagauugauuaaugaacuauuguuaauucuuccuauuuuaaugaaugacauugaacugaauuuuuugucuguuaaaugaacuugauagcuaauaaaaagacaacuagccaucaaaaaaaaaaa

SEQ ID NO: 52 - RNA, 1311 nt, Homo_Sapiens
ucuugccuuccggcccggcgcccgauuuccgccuuccgacccagcugugggcugcgccccacgccagcccgcgccccgcauggcugccgccggggccaggccuguggagcugggcuucgccgagucggcgccggcguggcgacugcgcagcgagcaguuccccagcaaggugggcgggcggccggcauggcugggcgcggccgggcugccggggccccaggcccuggccugcgagcugugcggccgcccgcucuccuuccugcugcagguguaugcgccgcugccuggccgcccggacgccuuccaccgcugcaucuuccucuucugcugccgcgagcagccgugcugugccggccugcgaguuuuuaggaaucaacuacccaggaaaaacgauuuuuacucauaugagccaccuucugagaauccucccccagaaacaggagaaucagugugucuccagcuuaagucuggugcucaucucugcaggguuuguggcuguuuaggccccaaaacgugcuccagaugccacaaagcauauuacugcagcaaggagcaucagacccuagacuggagauugggacauaagcaggcuugugcacaaccagaucaucuggaccauauaauuccagaccacaacuuccuuuuuccagaauuugaaauuguaauagaaacagaagaugagauuaugccugagguuguggaaaaggaagauuacucagagauuauagggagcaugggugaagcacuugaggaagaacuggauuccauggcaaaacaugaauccagggaagauaaaauuuuucagaaguuuaaaacucagauagcccuugaaccagaacagauucuuagauauggcagagguauugcccccaucuggauuucuggugaaaauauuccucaagaaaaggauauuccagauugccccuguggugccaagagaauauuggaauuccaggucaugccucagcuccuaaacuaccugaaggcugacagacugggcaagagcauugacuggggcauccuggcugucuucaccugugcugagagcugcagcuuggguacuggcuauacagaagaauuuguguggaagcaggauguaacagauacaccguaaaggcaucuuaaagccuugaaaaauguuaauaaucuuuuauaccuugcaauuccauuucugggauuuuauccuaaggaaauacuuauaccaaaaauagaggugcagagauguugacagauugcuuacacagugucuacuuauuagugaaacaaaaguguccagugacagggaauuaaauaaauuuugguacauccaca

SEQ ID NO: 53 - RNA, 2066 nt, Homo_Sapiens
ucuugccuuccggcccggcgcccgauuuccgccuuccgacccagcugugggcugcgccccacgccagcccgcgccccgcauggcugccgccggggccaggccuguggagcugggcuucgccgagucggcgccggcguggcgacugcgcagcgagcaguuccccagcaaggugggcgggcggccggcauggcugggcgcggccgggcugccggggccccaggcccuggccugcgagcugugcggccgcccgcucuccuuccugcugcagguguaugcgccgcugccuggccgcccggacgccuuccaccgcugcaucuuccucuucugcugccgcgagcagccgugcugugccggccugcgaguuuuuaggaaucaacuacccaggaaaaacgauuuuuacucauaugagccaccuucugagaauccucccccagaaacaggagaaucagugugucuccagcuuaagucuggugcucaucucugcaggguuuguggcuguuuaggccccaaaacgugcuccagaugccacaaagcauauuacugcagcaaggagcaucagacccuagacuggagauugggacauaagcaggcuugugcacaaccagaucaucuggaccauauaauuccagaccacaacuuccuuuuuccagaauuugaaauuguaauagaaacagaagaugagauuaugccugagguuguggaaaaggaagauuacucagagauuauagggagcauggguaagcaguuucaggacuucauucauuaagugguuaaacauaauacuuggaagaaagggcuccaugugccuagaagagagguacugagaggaagacucacuuuggaggcuguagcauacaauuuucagauauugccucagguaaaaauauacuuccuggacuuuguuuucugacacauaagagguguguucugcucccuguaaagacaaggguggguauccagauggucccaugaguagggcugcacaagaugcuggaggcuugguaaguuccucugggucgcagaucgguuucucgggucgggauagugugagugccuagcacagugucgggcacgcagaagggccccuuaaaaguuucucuuucaucuggccaguuuuagauacacaauuuugucaguuuacuuacagugcauacucuuggguaguacuugugcugaccaaguaucuuagaggcuuauuuuauuauaguagccaacauuuauccagcacuuaccuuauauaaagggcuguuugugcaugagcucauuaaaaucgugacagcagaccaaugagugagaaacugccccauuuugaaggugaggaaauugagguucuggguauaacuuucuuuggucacauaauauuaaauuuuacaauuugagccuugagccauacacaaaaccaccacaaaauuagauuuauagacucaaaaugaaaacaucagcuuacugguuuguaguucauaccagucauacauuccaaaacauguuuugagucuuacucugugccugaccuugugcuugauaacagggauauaaugggaagcaacacuccaguggucagaugcucacagucuuauggaggagcccaaauaauaucuggggaaguuaaaguccauauaaugacugauaagaguacaauacaggugccaugggaacacgugacaucacugaagacugccuggaaggggccgcgcguguguucaugccuauacgauaaacaugauacauaaugaaaaugcuuaucuuuaggagaaaggagagccuagaguagcaggaucaaggaugaaagcuggacuucaaauaugccuuguuaguguaaaugugacuguggaacuguaugaguauuuuaagauuauggaguaaaguaaguuuuaaaaagcagucccuaaucaucaaaaguaaaaaacucuugauguagucauauaaccacacuaagaacucuuccaggugacuucaaaacauaggacaguacaucucuaguagaauaugcccugagaaugaaaagaauguaacaguguuaguauuuugaauaaacauguuauuacuaaaaaaaaaaaaaaaaaaaa

SEQ ID NO: 54 - RNA, 4794 nt, Homo_Sapiens
cggccgggcgcacccgcggggcccugggcucgcuggcuugcgcgcagcugagcgggguguagguuggaagggccagggcccccuggggcgcaagugggggccggcgccauggaacccccgaccguccccucggaaaggagccugucucugucacugcccgggccccgggagggccaggccacccugaagccucccccgcagcaccuguggcggcagccucggacccccauccguauccagcagcgcggcuacuccgacagcgcggagcgcgccgagcgggagcggcagccgcaccggcccauagagcgcgccgaugccauggacaccagcgaccggcccggccugcgcacgacccgcauguccuggcccucguccuuccauggcacuggcaccggcagcggcggcgcgggcggaggcagcagcaggcgcuucgaggcagagaaugggccgacaccaucuccuggccgcagcccccuggacucgcaggcgagcccaggacucgugcugcacgccggggcggccaccagccagcgccgggaguccuuccuguaccgcucagacagcgacuaugacaugucacccaagaccaugucccggaacucaucggucaccagcgaggcgcacgcugaagaccucaucguaacaccauuugcucaggugcuggccagccuccggagcguccguagcaacuucucacuccugaccaaugugcccguucccaguaacaagcgguccccgcugggcggccccaccccugucugcaaggccacgcugucagaagaaacgugucagcaguuggcccgggagacucuggaggagcuggacuggugucuggagcagcuggagaccaugcagaccuaucgcucugucagcgagauggccucgcacaaguucaaaaggauguugaaccgugagcucacacaccugucagaaaugagcagguccggaaaccaggucucagaguacauuuccacaacauuccuggacaaacagaaugaaguggagaucccaucacccacgaugaaggaacgagaaaaacagcaagcgccgcgaccaagacccucccagccgcccccgcccccuguaccacacuuacagcccaugucccaaaucacaggguugaaaaaguugaugcauaguaacagccugaacaacucuaacauuccccgauuuggggugaagaccgaucaagaagagcuccuggcccaagaacuggagaaccugaacaaguggggccugaacaucuuuugcgugucggauuacgcuggaggccgcucacucaccugcaucauguacaugauauuccaggagcgggaccugcugaagaaauuccgcaucccuguggacacgauggugacauacaugcugacgcuggaggaucacuaccacgcugacguggccuaccauaacagccugcacgcagcugacgugcugcaguccacccacguacugcuggccacgccugcacuagaugcaguguucacggaccuggagauucucgccgcccucuucgcggcugccauccacgauguggaucacccuggggucuccaaccaguuccucaucaacaccaauucggagcuggcgcucauguacaacgaugagucggugcucgagaaucaccaccuggccgugggcuucaagcugcugcaggaggacaacugcgacaucuuccagaaccucagcaagcgccagcggcagagccuacgcaagauggucaucgacauggugcuggccacggacauguccaagcacaugacccuccuggcugaccugaagaccaugguggagaccaagaaagugaccagcucagggguccuccugcuagauaacuacuccgaccgcauccagguccuccggaacauggugcacugugccgaccucagcaaccccaccaagccgcuggagcuguaccgccaguggacagaccgcaucauggccgaguucuuccagcagggugaccgagagcgcgagcguggcauggaaaucagccccaugugugacaagcacacugccuccguggagaagucucagguggguuuuauugacuacauugugcacccauugugggagaccugggcggaccuuguccacccagaugcccaggagaucuuggacacuuuggaggacaaccgggacugguacuacagcgccauccggcagagcccaucuccgccacccgaggaggagucaagggggccaggccacccaccccugccugacaaguuccaguuugagcugacgcuggaggaggaagaggaggaagaaauaucaauggcccagauaccgugcacagcccaagaggcauugacugcgcagggauugucaggagucgaggaagcucuggaugcaaccauagccugggaggcauccccggcccaggagucguuggaaguuauggcacaggaagcaucccuggaggccgagcuggaggcaguguauuugacacagcaggcacaguccacaggcagugcaccuguggcuccggaugaguucucgucccgggaggaauucgugguugcuguaagccacagcagccccucugcccuggcucuucaaagcccccuucucccugcuuggaggacccugucuguuucagagcaugccccgggccucccgggccuccccuccacggcggccgagguggaggcccaacgagagcaccaggcugccaagagggcuugcagugccugcgcagggacauuuggggaggacacauccgcacucccagcuccugguggcggggggucagguggagacccuaccugauccccagaccucugucccuguuccccuccacuccuccccucacuccccugcucccccgaccaccuccuccucugccucaaagacucuuguccucuugucccuccugagaaaaaagaaaacgaaaagugggguuuuuuucuguuuucuuuuuuuccccuuucccccugcccccacccacggggccuuuuuuuggaggugggggcuggggaaugaggggcugaggucccggaagggauuuuauuuuuuugaauuuuaauuguaacauuuuuagaaaaagaacaaaaaaagaaaaaaaaaagaaagaaacacagcaacuguagaugcuccuguuccugguucccgcuuuccacuuccaaaucccuccccucaccuucccccacugccccccaaguuccaggcucagucuuccagccgccuggggagucucuaccugggcccaagcagguguggggccuccuucugggcuuuucuucugaauuuagaggauuucuagaacguggucaggaauagccauucuaggcggggcuggggccaggguggggggcagucacugugggaggucccagcuccagccccccucugguuugcugccuccucuccccucuaaaaaagucuuccgcuugauuuugcacaaucccggcgauacuccuggcgauacugacuagaaagucagggagcugggggagcuguucacuuuaggauacgggggugguauggaagggagcguucacaccgccagccucgggccugggauuugaggagggcccuagaccuccuccacucuccauccccuuucccuuccacuuuggguucacuuugaauuuucuccguuuuuuggggcaguggcucugauccacucacccccccgccccccgccccacuucuagcugcuucuccucuuguuucugccuuaauaauucccacggccacaggcaaggggguugcaguggccgccugcaccuuggaugaggcagggccaggcgcccagaacccccauccuggccgcaccccccuuuccaggguccuccggaccccaccuuccacacucugaucacagccccccuaccuuuugcccuaggaggaagcaauaaugguguauacccucauucucauuccugggcagcccuuccuuccacccuggcaccaaaauaauuucuccuccauccguaccuugccuagccucucccucucccccagcuagucccugagcaauacggcagacagaugcaagaccauuuuucuccaagccaugggggacuguuuggaaggaaagcccccucucucccuccuccccucgcccucggccugguucugcagcuggaccgaccucauucaucgccugcccccuacccaauucugagcacacgguacuguagcccccaguuccucccuagccuuccaucccucuguccaccccagggggagguaaccccgcacucacacucccuugaugcugucuguacaggguucauauuuuguagcgaaagucguuuuugucccagccggcgaucggagugggccuuuucuuucuuuuuguucauucuuuaccuuuuuuucuuuucuuucuuucuuuuuuguacauacuguaagguugguuuguaaauuauucuacggaggcaaaaagggaaaauaaaaacuugcccuucccuggcugacccagucgggaagguagggaaggaggucucccguugggagagucucuguuccugcuguauuauacaaacuguaccauaguccugggaaaaggguggacucaccgcuguuguuuuaugggaagucgugucauccuagggguuggggcugggcagagccuguccccuccccccuucuccaggagccagggggugacuggagagacagacccacccccaagcagggcuccucuccccagggugagcacaggaccucuguaagcugcuuguguauuguccacuuugacgaucagucauucgguccguugaucaauaauccuucgaucuugucuccaauuaaaccgaggcuuucaccgauaaaaaaaaaaaaaaa

SEQ ID NO: 55 - RNA, 4608 nt, Homo_Sapiens
auggcgcggccgcgcggccuaggccgcaucccggagcugcaacugguggccuucccgguggcgguggcggcugaggacgaggcguuccugcccgagccccuggccccgcgcgcgccccgccgcccgcguucgccgcccuccucgcccgucuucuucgccagcccguccccaacuuuccgcagacgccuucggcuucuccgcagcugccaggauuugggccgccaggcuugggcuggggcuggcuucgaggcagagaaugggccgacaccaucuccuggccgcagcccccuggacucgcaggcgagcccaggacucgugcugcacgccggggcggccaccagccagcgccgggaguccuuccuguaccgcucagacagcgacuaugacaugucacccaagaccaugucccggaacucaucggucaccagcgaggcgcacgcugaagaccucaucguaacaccauuugcucaggugcuggccagccuccggagcguccguagcaacuucucacuccugaccaaugugcccguucccaguaacaagcgguccccgcugggcggccccaccccugucugcaaggccacgcugucagaagaaacgugucagcaguuggcccgggagacucuggaggagcuggacuggugucuggagcagcuggagaccaugcagaccuaucgcucugucagcgagauggccucgcacaaguucaaaaggauguugaaccgugagcucacacaccugucagaaaugagcagguccggaaaccaggucucagaguacauuuccacaacauuccuggacaaacagaaugaaguggagaucccaucacccacgaugaaggaacgagaaaaacagcaagcgccgcgaccaagacccucccagccgcccccgcccccuguaccacacuuacagcccaugucccaaaucacaggguugaaaaaguugaugcauaguaacagccugaacaacucuaacauuccccgauuuggggugaagaccgaucaagaagagcuccuggcccaagaacuggagaaccugaacaaguggggccugaacaucuuuugcgugucggauuacgcuggaggccgcucacucaccugcaucauguacaugauauuccaggagcgggaccugcugaagaaauuccgcaucccuguggacacgauggugacauacaugcugacgcuggaggaucacuaccacgcugacguggccuaccauaacagccugcacgcagcugacgugcugcaguccacccacguacugcuggccacgccugcacuagaugcaguguucacggaccuggagauucucgccgcccucuucgcggcugccauccacgauguggaucacccuggggucuccaaccaguuccucaucaacaccaauucggagcuggcgcucauguacaacgaugagucggugcucgagaaucaccaccuggccgugggcuucaagcugcugcaggaggacaacugcgacaucuuccagaaccucagcaagcgccagcggcagagccuacgcaagauggucaucgacauggugcuggccacggacauguccaagcacaugacccuccuggcugaccugaagaccaugguggagaccaagaaagugaccagcucagggguccuccugcuagauaacuacuccgaccgcauccagguccuccggaacauggugcacugugccgaccucagcaaccccaccaagccgcuggagcuguaccgccaguggacagaccgcaucauggccgaguucuuccagcagggugaccgagagcgcgagcguggcauggaaaucagccccaugugugacaagcacacugccuccguggagaagucucagguggguuuuauugacuacauugugcacccauugugggagaccugggcggaccuuguccacccagaugcccaggagaucuuggacacuuuggaggacaaccgggacugguacuacagcgccauccggcagagcccaucuccgccacccgaggaggagucaagggggccaggccacccaccccugccugacaaguuccaguuugagcugacgcuggaggaggaagaggaggaagaaauaucaauggcccagauaccgugcacagcccaagaggcauugacugcgcagggauugucaggagucgaggaagcucuggaugcaaccauagccugggaggcauccccggcccaggagucguuggaaguuauggcacaggaagcaucccuggaggccgagcuggaggcaguguauuugacacagcaggcacaguccacaggcagugcaccuguggcuccggaugaguucucgucccgggaggaauucgugguugcuguaagccacagcagccccucugcccuggcucuucaaagcccccuucucccugcuuggaggacccugucuguuucagagcaugccccgggccucccgggccuccccuccacggcggccgagguggaggcccaacgagagcaccaggcugccaagagggcuugcagugccugcgcagggacauuuggggaggacacauccgcacucccagcuccugguggcggggggucagguggagacccuaccugauccccagaccucugucccuguuccccuccacuccuccccucacuccccugcucccccgaccaccuccuccucugccucaaagacucuuguccucuugucccuccugagaaaaaagaaaacgaaaagugggguuuuuuucuguuuucuuuuuuuccccuuucccccugcccccacccacggggccuuuuuuuggaggugggggcuggggaaugaggggcugaggucccggaagggauuuuauuuuuuugaauuuuaauuguaacauuuuuagaaaaagaacaaaaaaagaaaaaaaaaagaaagaaacacagcaacuguagaugcuccuguuccugguucccgcuuuccacuuccaaaucccuccccucaccuucccccacugccccccaaguuccaggcucagucuuccagccgccuggggagucucuaccugggcccaagcagguguggggccuccuucugggcuuuucuucugaauuuagaggauuucuagaacguggucaggaauagccauucuaggcggggcuggggccaggguggggggcagucacugugggaggucccagcuccagccccccucugguuugcugccuccucuccccucuaaaaaagucuuccgcuugauuuugcacaaucccggcgauacuccuggcgauacugacuagaaagucagggagcugggggagcuguucacuuuaggauacgggggugguauggaagggagcguucacaccgccagccucgggccugggauuugaggagggcccuagaccuccuccacucuccauccccuuucccuuccacuuuggguucacuuugaauuuucuccguuuuuuggggcaguggcucugauccacucacccccccgccccccgccccacuucuagcugcuucuccucuuguuucugccuuaauaauucccacggccacaggcaaggggguugcaguggccgccugcaccuuggaugaggcagggccaggcgcccagaacccccauccuggccgcaccccccuuuccaggguccuccggaccccaccuuccacacucugaucacagccccccuaccuuuugcccuaggaggaagcaauaaugguguauacccucauucucauuccugggcagcccuuccuuccacccuggcaccaaaauaauuucuccuccauccguaccuugccuagccucucccucucccccagcuagucccugagcaauacggcagacagaugcaagaccauuuuucuccaagccaugggggacuguuuggaaggaaagcccccucucucccuccuccccucgcccucggccugguucugcagcuggaccgaccucauucaucgccugcccccuacccaauucugagcacacgguacuguagcccccaguuccucccuagccuuccaucccucuguccaccccagggggagguaaccccgcacucacacucccuugaugcugucuguacaggguucauauuuuguagcgaaagucguuuuugucccagccggcgaucggagugggccuuuucuuucuuuuuguucauucuuuaccuuuuuuucuuuucuuucuuucuuuuuuguacauacuguaagguugguuuguaaauuauucuacggaggcaaaaagggaaaauaaaaacuugcccuucccuggcugacccagucgggaagguagggaaggaggucucccguugggagagucucuguuccugcuguauuauacaaacuguaccauaguccugggaaaaggguggacucaccgcuguuguuuuaugggaagucgugucauccuagggguuggggcugggcagagccuguccccuccccccuucuccaggagccagggggugacuggagagacagacccacccccaagcagggcuccucuccccagggugagcacaggaccucuguaagcugcuuguguauuguccacuuugacgaucagucauucgguccguugaucaauaauccuucgaucuugucuccaauuaaaccgaggcuuucaccgauaaaaaaaaaaaaaaa

SEQ ID NO: 56 - RNA, 4503 nt, Homo_Sapiens
augcgcuccggugcagcgccccgggcccggccccggcccccugcccuggcacugccccccacgggccccgagucccugacccacuuccccuucagcgaugaggacacccgucggcacccuccgggcagaucugucagcuucgaggcagagaaugggccgacaccaucuccuggccgcagcccccuggacucgcaggcgagcccaggacucgugcugcacgccggggcggccaccagccagcgccgggaguccuuccuguaccgcucagacagcgacuaugacaugucacccaagaccaugucccggaacucaucggucaccagcgaggcgcacgcugaagaccucaucguaacaccauuugcucaggugcuggccagccuccggagcguccguagcaacuucucacuccugaccaaugugcccguucccaguaacaagcgguccccgcugggcggccccaccccugucugcaaggccacgcugucagaagaaacgugucagcaguuggcccgggagacucuggaggagcuggacuggugucuggagcagcuggagaccaugcagaccuaucgcucugucagcgagauggccucgcacaaguucaaaaggauguugaaccgugagcucacacaccugucagaaaugagcagguccggaaaccaggucucagaguacauuuccacaacauuccuggacaaacagaaugaaguggagaucccaucacccacgaugaaggaacgagaaaaacagcaagcgccgcgaccaagacccucccagccgcccccgcccccuguaccacacuuacagcccaugucccaaaucacaggguugaaaaaguugaugcauaguaacagccugaacaacucuaacauuccccgauuuggggugaagaccgaucaagaagagcuccuggcccaagaacuggagaaccugaacaaguggggccugaacaucuuuugcgugucggauuacgcuggaggccgcucacucaccugcaucauguacaugauauuccaggagcgggaccugcugaagaaauuccgcaucccuguggacacgauggugacauacaugcugacgcuggaggaucacuaccacgcugacguggccuaccauaacagccugcacgcagcugacgugcugcaguccacccacguacugcuggccacgccugcacuagaugcaguguucacggaccuggagauucucgccgcccucuucgcggcugccauccacgauguggaucacccuggggucuccaaccaguuccucaucaacaccaauucggagcuggcgcucauguacaacgaugagucggugcucgagaaucaccaccuggccgugggcuucaagcugcugcaggaggacaacugcgacaucuuccagaaccucagcaagcgccagcggcagagccuacgcaagauggucaucgacauggugcuggccacggacauguccaagcacaugacccuccuggcugaccugaagaccaugguggagaccaagaaagugaccagcucagggguccuccugcuagauaacuacuccgaccgcauccagguccuccggaacauggugcacugugccgaccucagcaaccccaccaagccgcuggagcuguaccgccaguggacagaccgcaucauggccgaguucuuccagcagggugaccgagagcgcgagcguggcauggaaaucagccccaugugugacaagcacacugccuccguggagaagucucagguggguuuuauugacuacauugugcacccauugugggagaccugggcggaccuuguccacccagaugcccaggagaucuuggacacuuuggaggacaaccgggacugguacuacagcgccauccggcagagcccaucuccgccacccgaggaggagucaagggggccaggccacccaccccugccugacaaguuccaguuugagcugacgcuggaggaggaagaggaggaagaaauaucaauggcccagauaccgugcacagcccaagaggcauugacugcgcagggauugucaggagucgaggaagcucuggaugcaaccauagccugggaggcauccccggcccaggagucguuggaaguuauggcacaggaagcaucccuggaggccgagcuggaggcaguguauuugacacagcaggcacaguccacaggcagugcaccuguggcuccggaugaguucucgucccgggaggaauucgugguugcuguaagccacagcagccccucugcccuggcucuucaaagcccccuucucccugcuuggaggacccugucuguuucagagcaugccccgggccucccgggccuccccuccacggcggccgagguggaggcccaacgagagcaccaggcugccaagagggcuugcagugccugcgcagggacauuuggggaggacacauccgcacucccagcuccugguggcggggggucagguggagacccuaccugauccccagaccucugucccuguuccccuccacuccuccccucacuccccugcucccccgaccaccuccuccucugccucaaagacucuuguccucuugucccuccugagaaaaaagaaaacgaaaagugggguuuuuuucuguuuucuuuuuuuccccuuucccccugcccccacccacggggccuuuuuuuggaggugggggcuggggaaugaggggcugaggucccggaagggauuuuauuuuuuugaauuuuaauuguaacauuuuuagaaaaagaacaaaaaaagaaaaaaaaaagaaagaaacacagcaacuguagaugcuccuguuccugguucccgcuuuccacuuccaaaucccuccccucaccuucccccacugccccccaaguuccaggcucagucuuccagccgccuggggagucucuaccugggcccaagcagguguggggccuccuucugggcuuuucuucugaauuuagaggauuucuagaacguggucaggaauagccauucuaggcggggcuggggccaggguggggggcagucacugugggaggucccagcuccagccccccucugguuugcugccuccucuccccucuaaaaaagucuuccgcuugauuuugcacaaucccggcgauacuccuggcgauacugacuagaaagucagggagcugggggagcuguucacuuuaggauacgggggugguauggaagggagcguucacaccgccagccucgggccugggauuugaggagggcccuagaccuccuccacucuccauccccuuucccuuccacuuuggguucacuuugaauuuucuccguuuuuuggggcaguggcucugauccacucacccccccgccccccgccccacuucuagcugcuucuccucuuguuucugccuuaauaauucccacggccacaggcaaggggguugcaguggccgccugcaccuuggaugaggcagggccaggcgcccagaacccccauccuggccgcaccccccuuuccaggguccuccggaccccaccuuccacacucugaucacagccccccuaccuuuugcccuaggaggaagcaauaaugguguauacccucauucucauuccugggcagcccuuccuuccacccuggcaccaaaauaauuucuccuccauccguaccuugccuagccucucccucucccccagcuagucccugagcaauacggcagacagaugcaagaccauuuuucuccaagccaugggggacuguuuggaaggaaagcccccucucucccuccuccccucgcccucggccugguucugcagcuggaccgaccucauucaucgccugcccccuacccaauucugagcacacgguacuguagcccccaguuccucccuagccuuccaucccucuguccaccccagggggagguaaccccgcacucacacucccuugaugcugucuguacaggguucauauuuuguagcgaaagucguuuuugucccagccggcgaucggagugggccuuuucuuucuuuuuguucauucuuuaccuuuuuuucuuuucuuucuuucuuuuuuguacauacuguaagguugguuuguaaauuauucuacggaggcaaaaagggaaaauaaaaacuugcccuucccuggcugacccagucgggaagguagggaaggaggucucccguugggagagucucuguuccugcuguauuauacaaacuguaccauaguccugggaaaaggguggacucaccgcuguuguuuuaugggaagucgugucauccuagggguuggggcugggcagagccuguccccuccccccuucuccaggagccagggggugacuggagagacagacccacccccaagcagggcuccucuccccagggugagcacaggaccucuguaagcugcuuguguauuguccacuuugacgaucagucauucgguccguugaucaauaauccuucgaucuugucuccaauuaaaccgaggcuuucaccgauaaaaaaaaaaaaaaa

SEQ ID NO: 57 - RNA, 4276 nt, Homo_Sapiens
uccgcagccuccuccugggacccuugcccugccccccucccaugggcacggaccccccaccgccuccacccacugccgcgggggggcccguuggggcccagggcuggcgggccauguaaccagggcugcugcugggagcgcggaggggaagggagcccccagcccugcugggccggcccaggccccuccgcggcucccccuuccacuacccaccugcccggcacccccuccccagugguuguuaaccccgggacuccccaagcccagccucugugugcagcagccccaggcgggcuaagucuccaagaugcccuugguggauuucuucugcgagaccugcucuaagccuuggcuggugggcuggugggaccaguucaaaaggauguugaaccgugagcucacacaccugucagaaaugagcagguccggaaaccaggucucagaguacauuuccacaacauuccuggacaaacagaaugaaguggagaucccaucacccacgaugaaggaacgagaaaaacagcaagcgccgcgaccaagacccucccagccgcccccgcccccuguaccacacuuacagcccaugucccaaaucacaggguugaaaaaguugaugcauaguaacagccugaacaacucuaacauuccccgauuuggggugaagaccgaucaagaagagcuccuggcccaagaacuggagaaccugaacaaguggggccugaacaucuuuugcgugucggauuacgcuggaggccgcucacucaccugcaucauguacaugauauuccaggagcgggaccugcugaagaaauuccgcaucccuguggacacgauggugacauacaugcugacgcuggaggaucacuaccacgcugacguggccuaccauaacagccugcacgcagcugacgugcugcaguccacccacguacugcuggccacgccugcacuagaugcaguguucacggaccuggagauucucgccgcccucuucgcggcugccauccacgauguggaucacccuggggucuccaaccaguuccucaucaacaccaauucggagcuggcgcucauguacaacgaugagucggugcucgagaaucaccaccuggccgugggcuucaagcugcugcaggaggacaacugcgacaucuuccagaaccucagcaagcgccagcggcagagccuacgcaagauggucaucgacauggugcuggccacggacauguccaagcacaugacccuccuggcugaccugaagaccaugguggagaccaagaaagugaccagcucagggguccuccugcuagauaacuacuccgaccgcauccagguccuccggaacauggugcacugugccgaccucagcaaccccaccaagccgcuggagcuguaccgccaguggacagaccgcaucauggccgaguucuuccagcagggugaccgagagcgcgagcguggcauggaaaucagccccaugugugacaagcacacugccuccguggagaagucucagguggguuuuauugacuacauugugcacccauugugggagaccugggcggaccuuguccacccagaugcccaggagaucuuggacacuuuggaggacaaccgggacugguacuacagcgccauccggcagagcccaucuccgccacccgaggaggagucaagggggccaggccacccaccccugccugacaaguuccaguuugagcugacgcuggaggaggaagaggaggaagaaauaucaauggcccagauaccgugcacagcccaagaggcauugacugcgcagggauugucaggagucgaggaagcucuggaugcaaccauagccugggaggcauccccggcccaggagucguuggaaguuauggcacaggaagcaucccuggaggccgagcuggaggcaguguauuugacacagcaggcacaguccacaggcagugcaccuguggcuccggaugaguucucgucccgggaggaauucgugguugcuguaagccacagcagccccucugcccuggcucuucaaagcccccuucucccugcuuggaggacccugucuguuucagagcaugccccgggccucccgggccuccccuccacggcggccgagguggaggcccaacgagagcaccaggcugccaagagggcuugcagugccugcgcagggacauuuggggaggacacauccgcacucccagcuccugguggcggggggucagguggagacccuaccugauccccagaccucugucccuguuccccuccacuccuccccucacuccccugcucccccgaccaccuccuccucugccucaaagacucuuguccucuugucccuccugagaaaaaagaaaacgaaaagugggguuuuuuucuguuuucuuuuuuuccccuuucccccugcccccacccacggggccuuuuuuuggaggugggggcuggggaaugaggggcugaggucccggaagggauuuuauuuuuuugaauuuuaauuguaacauuuuuagaaaaagaacaaaaaaagaaaaaaaaaagaaagaaacacagcaacuguagaugcuccuguuccugguucccgcuuuccacuuccaaaucccuccccucaccuucccccacugccccccaaguuccaggcucagucuuccagccgccuggggagucucuaccugggcccaagcagguguggggccuccuucugggcuuuucuucugaauuuagaggauuucuagaacguggucaggaauagccauucuaggcggggcuggggccaggguggggggcagucacugugggaggucccagcuccagccccccucugguuugcugccuccucuccccucuaaaaaagucuuccgcuugauuuugcacaaucccggcgauacuccuggcgauacugacuagaaagucagggagcugggggagcuguucacuuuaggauacgggggugguauggaagggagcguucacaccgccagccucgggccugggauuugaggagggcccuagaccuccuccacucuccauccccuuucccuuccacuuuggguucacuuugaauuuucuccguuuuuuggggcaguggcucugauccacucacccccccgccccccgccccacuucuagcugcuucuccucuuguuucugccuuaauaauucccacggccacaggcaaggggguugcaguggccgccugcaccuuggaugaggcagggccaggcgcccagaacccccauccuggccgcaccccccuuuccaggguccuccggaccccaccuuccacacucugaucacagccccccuaccuuuugcccuaggaggaagcaauaaugguguauacccucauucucauuccugggcagcccuuccuuccacccuggcaccaaaauaauuucuccuccauccguaccuugccuagccucucccucucccccagcuagucccugagcaauacggcagacagaugcaagaccauuuuucuccaagccaugggggacuguuuggaaggaaagcccccucucucccuccuccccucgcccucggccugguucugcagcuggaccgaccucauucaucgccugcccccuacccaauucugagcacacgguacuguagcccccaguuccucccuagccuuccaucccucuguccaccccagggggagguaaccccgcacucacacucccuugaugcugucuguacaggguucauauuuuguagcgaaagucguuuuugucccagccggcgaucggagugggccuuuucuuucuuuuuguucauucuuuaccuuuuuuucuuuucuuucuuucuuuuuuguacauacuguaagguugguuuguaaauuauucuacggaggcaaaaagggaaaauaaaaacuugcccuucccuggcugacccagucgggaagguagggaaggaggucucccguugggagagucucuguuccugcuguauuauacaaacuguaccauaguccugggaaaaggguggacucaccgcuguuguuuuaugggaagucgugucauccuagggguuggggcugggcagagccuguccccuccccccuucuccaggagccagggggugacuggagagacagacccacccccaagcagggcuccucuccccagggugagcacaggaccucuguaagcugcuuguguauuguccacuuugacgaucagucauucgguccguugaucaauaauccuucgaucuugucuccaauuaaaccgaggcuuucaccgauaaaaaaaaaaaaaaa

SEQ ID NO: 58 - RNA, 8240 nt, Homo_Sapiens
ccccucucgguagcccugaggcucuggcgccuucaagugagaagcuaagcaccagccucugcugggcugcagaagcggcggcggcggcagcagcagcagcagcaucaggaaggcgcucgggccagcgcggugaacccgggcugggcagcaggucgcggagccgcgagccaggauggaggcagagggcagcagcgcgccggcccgggcgggcagcggagagggcagcgacagcgccggcggggccacgcucaaagcccccaagcaucucuggaggcacgagcagcaccaccaguacccgcuccggcagccccaguuccgccuccugcauccccaucaccaccugcccccgccgccgccacccucgccccagccccagccccaguguccgcuacagccgccgccgccgcccccccugccgccgcccccgccgccgcccggggcugcccgcggccgcuacgccucgagcggggccaccggccgcguccggcaucgcggcuacucggacaccgagcgcuaccuguacugucgcgccauggaccgcaccuccuacgcgguggagaccggccaccggcccggccugaagaaauccaggauguccuggcccuccucguuccagggacucaggcguuuugauguggacaauggcacaucugcgggacggagucccuuggaucccaugaccagcccaggauccgggcuaauucuccaagcaaauuuuguccacagucaacgacgggaguccuuccuguaucgauccgacagcgauuaugaccucucuccaaagucuaugucccggaacuccuccauugccagugauauacacggagaugacuugauugugacuccauuugcucaggucuuggccagucugcgaacuguacgaaacaacuuugcugcauuaacuaauuugcaagaucgagcaccuagcaaaagaucacccaugugcaaccaaccauccaucaacaaagccaccauaacagaggaggccuaccagaaacuggccagcgagacccuggaggagcuggacuggugucuggaccagcuagagacccuacagaccaggcacuccgucagugagauggccuccaacaaguuuaaaaggaugcuuaaucgggagcucacccaucucucugaaaugagucggucuggaaaucaagugucagaguuuauaucaaacacauucuuagauaagcaacaugaaguggaaauuccuucuccaacucagaaggaaaaggagaaaaagaaaagaccaaugucucagaucaguggagucaagaaauugaugcacagcucuagucugacuaauucaaguaucccaagguuuggaguuaaaacugaacaagaagauguccuugccaaggaacuagaagaugugaacaaauggggucuucauguuuucagaauagcagaguugucugguaaccggcccuugacuguuaucaugcacaccauuuuucaggaacgggauuuauuaaaaacauuuaaaauuccaguagauacuuuaauuacauaucuuaugacucucgaagaccauuaccaugcugauguggccuaucacaacaauauccaugcugcagauguuguccagucuacucaugugcuauuaucuacaccugcuuuggaggcuguguuuacagauuuggagauucuugcagcaauuuuugccagugcaauacaugauguagaucauccugguguguccaaucaauuucugaucaauacaaacucugaacuugccuugauguacaaugauuccucagucuuagagaaccaucauuuggcugugggcuuuaaauugcuucaggaagaaaacugugacauuuuccagaauuugaccaaaaaacaaagacaaucuuuaaggaaaauggucauugacaucguacuugcaacagauaugucaaaacacaugaaucuacuggcugauuugaagacuaugguugaaacuaagaaagugacaagcucuggaguucuucuucuugauaauuauuccgauaggauucagguucuucagaauauggugcacugugcagaucugagcaacccaacaaagccucuccagcuguaccgccaguggacggaccggauaauggaggaguucuuccgccaaggagaccgagagagggaacguggcauggagauaagccccaugugugacaagcacaaugcuuccguggaaaaaucacaggugggcuucauagacuauauuguucauccccucugggagacaugggcagaccucguccacccugacgcccaggauauuuuggacacuuuggaggacaaucgugaaugguaccagagcacaaucccucagagccccucuccugcaccugaugacccagaggagggccggcagggucaaacugagaaauuccaguuugaacuaacuuuagaggaagauggugagucagacacggaaaaggacaguggcagucaaguggaagaagacacuagcugcagugacuccaagacucuuuguacucaagacucagagucuacugaaauuccccuugaugaacagguugaagaggaggcaguaggggaagaagaggaaagccagccugaagccugugucauagaugaucguucuccugacacguaacagugcaaaaacuuucaugccuuuuuuuuuuuuaaguagaaaaauuguuuccaaagugcaugucacaugccacaaccacggucacaccucacugucaucugccaggacguuuguugaacaaaacugaccuugacuacucaguccagcgcucaggaauaucguaaccaguuuuuucaccuccaugucauccgagcaagguggacaucuucacgaacagcguuuuuaacaagauuucagcuugguagagcugacaaagcagauaaaaucuacuccaaauuauuuucaagagagugugacucaucaggcagcccaaaaguuuauuggacuugggguuucuauuccuuuuuauuuguuugcaauauuuucagaagaaaggcauugcacagagugaacuuaauggacgaagcaacaaauaugucaagaacaggacauagcacgaaucuguuaccaguaggaggaggaugagccacagaaauugcauaauuuucuaauuucaagucuuccugauacaugacugaauagugugguucagugagcugcacugaccucuacauuuuguaugauauguaaaacagauuuuuuguagagcuuacuuuuauuauuaaauguauugagguauuauauuuaaaaaaaacuauguucagaacuucaucugccacugguuauuuuuuucuaaggaguaacuugcaaguuuucaguacaaaucugugcuacacuggauaaaaaucuaauuuaugaauuuuacuugcaccuuauaguucauagcaauuaacugauuuguagugauucauuguuuguuuuauauaccaaugacuuccauauuuuaaaagagaaaaacaacuuuauguugcaggaaacccuuuuuguaagucuuuauuauuuacuuugcauuuuguuucacucuuuccagauaagcagaguugcucuucaccaguguuuuucuucaugugcaaagugacuauuuguucuauaauacuuuuauguguguuauaucaaaugugucuuaagcuucaugcaaacucagucaucaguucguguugucugaagcaagugggagauauauaaauacccaguagcuaaaauggucagucuuuuuuagauguuuuccuacuuaguaucuccuaauaacguuuugcugugucacuagauguucauuucacaagugcaugucuuucuaauaauccacacauuucaugcucuaauaauccacacauuucaugcucauuuuuauuguuuuuacagccaguuauaguaagaaaaagguuuuuccccuugugcugcuuuauaauuuagcgugugucugaaccuuauccauguuugcuagaugaggucuugucaaauauaucacuaccauugucaccggugaaaagaaacagguaguuaaguuaggguuaacauucauuucaaccacgagguuguauaucaugacuagcuuuuacucuugguuuacagagaaaaguuaaacagccaacuaggcaguuuuuaagaauauuaacaauauauuaacaaacaccaauacaacuaauccuauuugguuuuaaugauuucaccaugggauuaagaacuauaucaggaacaucccugagaaacgguuuuaaguguagcaacuacucuuccuuaauggacagccacauaacguguaggaaguccuuuaucacuuauccucgauccauaagcauaucuugcagaggggaacuacuucuuuaaacacauggagggaaagaagaugaugccacuggcaccagaggguuaguacugugaugcauccuaaaauauuuauuauauugguaaaaauucugguuaaauaaaaaauuagagaucacucuuggcugauuucagcaccaggaacuguauuacaguuuuagagauuaauuccuaguguuuaccugauuauagcaguuggcaucauggggcauuuaauucugacuuuauccccacgucagccuuaauaaagucuucuuuaccuucucuaugaagacuuuaaagcccaaauaaucauuuuucacauugauauucaagaauugagauagauagaagccaaaguggguaucugacaaguggaaaaucaaacguuuaagaagaauuacaacucugaaaagcauuuauauguggaacuucucaaggagccuccuggggacuggaaaguaagucaucagccaggcaaaugacucaugcugaagagaguccccauuucaguccccugagaucuagcugaugcuuagauccuuugaaauaaaaauuaugucuuuauaacucugaucuuuuacauaaagcagaagaggaaucaacuaguuaauugcaagguuucuacucuguuuccucuguaaagaucagaugguaaucuuucaaauaagaaaaaaauaaagacguauguuugaccaaguaguuucacaagaauauuugggaacuuguuucuuuuaauuuuauuugucccugagugaagucuagaaagaaagguaaagagucuagaguuuauuccucuuuccaaaacauucucauuccucuccucccuacacuuaguauuucccccacagagugccuagaaucuuaauaaugaauaaaauaaaaagcagcaauaugucauuaacaaauccagaccugaaaggguaaaggguuuauaacugcacuaauaaagagaggcucuuuuuuuuucuuccaguuuguugguuuuuaaugguaccguguuguaaagauacccacuaauggacaaucaaauugcagaaaaggcucaauauccaagagacagggacuaaugcacuguacaaucugcuuauccuugcccuucucucuugccaaagugugcuucagaaauauauacugcuuuaaaaaagaauaaaagaauauccuuuuacaaguggcuuuacauuuccuaaaaugccauaagaaaaugcaauaucuggguacuguauggggaaaaaaauguccaaguuuguguaaaaccagugcauuucagcuugcaaguuacugaacacaauaaugcuguuuuaauuuuguuuuauaucaguuaaaauucacaauaauguagauagaacaaauuacagacaaggaaagaaaaaacuugaaugaaauggauuuuacagaaagcuuuaugauaauuuuugaaugcauuauuuauuuuuugugccaugcauuuuuuuucucaccaaaugaccuuaccuguaauacagucuuguuugucuguuuacaaccauguauuuauugcaauguacauacuguaauguuaauuguaaauuaucuguucuuauuaaaacaucaucccaugaugggaugguguugauauauuuggaaacucuuggugagagaaugaaugguguguauacauacucuguacauuuuucuuuucuccuguaauauagucuugucaccuuagagcuuguuuauggaagauucaagaaaacuauaaaauacuuaaagauauauaaauuuaaaaaaacauagcugcaggucuuuggucccagggcugugccuuaacuuuaaccaauauuuucuucuguuuugcugcauuugaaagguaacaguggagcuagggcugggcauuuuacauccaggcuuuuaauugauuagaauucugccaauagguggauuuuacaaaaccacagacaaccucugaaagauucugagacccuuuugagacagaagcucuuaaguacuucuugccagggagcagcacugcaugugugaugguuguuugccaucuguugaucaggaacuacuucagcuacuugcauuugauuauuuccuuuuuuuuuuuuuuuaacucggaaacacaacuggggaaauauauucuuucccagugauuauaaacaaucuuuuucuuuuuuuuaaguccuuuuggcuucuagagcucauaggaaaauggacuugauuugaaauuggagccagaguuuacucguguugguuaucuauucaucagcuuccugacauguuaagagaauacauuaaagagaaaauacuguuuuuuaauccuaaaauuuuucuuccacuaagauaaaccaaauguccuuacauauauguaaacccaucuauuuaaacgcaaagguggguugaugucaguuuacauagcagaaagcauucacuauccucuaagauuuguuucugcaaaacuuucauugcuuuagaauuuuaaaauuucaccuuguacaauggccagccccuaaagcaggaaacauuuauaauggauuauauggaaacauccucccaguacuugcccagcccuugaaucauguggcuuuucagugaaaggaaagauucuuuuucuaggaaaaaugagccuauuuuauuuuauuuuauuuuauuuuuugacacaaacuguagauuuuagcagcccuggcccaaaggaauuugauuacuuuuguuuuaaacaguacaaaggggacacuauaauuacaaaaacauccuuaacugauuugaguuguuuuuauuucuuuggauauauuuucagagugguaaauugugugugagaauuacaaaugauuauucuuuuagugguuucuuagccucucuuacagcccacggggauaguacuguacaucaauaccuucauaugaaauuuuuauaugcaaugaaaauaaaagcauggguugauucugccuauuuaugacucaaucuuuuacaaauaaaagauuauucauuuuaaauuauaguucaaucagcaugucucuuaggauacugaacgugguugaaaugaaaggauagugacaucauaaguuaguacugauauucauaaccaaauaaagccaacuugaguaauuuugcuacauuaaaaauuaccaaaauuacuuagauggccuauaagauuaagcaugguguuuucuaagcaagcuuugaaaggggccuuccauacuuacuuaauugaauauucugggauauugaaaauuauucagauacuugacaauuauuuuugguuaccuacuccgcaaacuacaaaguuuuaaggacucaacaauaaguuaaugagacacaguguuugcuuucauggagcuuacagucuggaggggacaaaggcuuaaacaauacucauauaauuauauaugugaucaguacaaugaaggagcucagugggguaaauaagcaggaaccugaacuugaucuguuccggagggccacagaaggcuuccuugaggccuugagaaagugauuugcaucugaguucugaaggauuguaagagguaacuagggaaaaaguugacaggaagaggaaggggauccagacaagaaacauuugcaaagaucuugaggcauaaaugagcuugagacaucuggagaaacugaggaaaagugagagaguaggcagggccuggagccgcagagccauugcuaaccauccugugugagauaucccccauucuguagcuuuauucucauaacccugcucaauuuucuuuauaacacuucucacagauuuauauacguguuuguuuuuguuaucugucucucccaccagaccacagcuccaugagagcaaggucuuugcuuaccaauauaucacuagcacuuaaaacuaugccugguacacaguagguucuuaauauguguugaauauagccaucaaauugauauuggauauaauucaaucugauaagauauuuugagauauuaaagaguuuuuaacuugauaccauaaaaaaaaaaaaaaaaa

SEQ ID NO: 59 - RNA, 7783 nt, Homo_Sapiens
aauacuuguugcaauaauugcccacgauagcugcucaaacaagagaguuggaauucaucuguaaaaaucacuacauguaacguaggagacaagaaaaauauuaaugacagaagaucugcgaacaugaugcacgugaauaauuuucccuuuagaaggcauuccuggauauguuuugauguggacaauggcacaucugcgggacggagucccuuggaucccaugaccagcccaggauccgggcuaauucuccaagcaaauuuuguccacagucaacgacgggaguccuuccuguaucgauccgacagcgauuaugaccucucuccaaagucuaugucccggaacuccuccauugccagugauauacacggagaugacuugauugugacuccauuugcucaggucuuggccagucugcgaacuguacgaaacaacuuugcugcauuaacuaauuugcaagaucgagcaccuagcaaaagaucacccaugugcaaccaaccauccaucaacaaagccaccauaacagaggaggccuaccagaaacuggccagcgagacccuggaggagcuggacuggugucuggaccagcuagagacccuacagaccaggcacuccgucagugagauggccuccaacaaguuuaaaaggaugcuuaaucgggagcucacccaucucucugaaaugagucggucuggaaaucaagugucagaguuuauaucaaacacauucuuagauaagcaacaugaaguggaaauuccuucuccaacucagaaggaaaaggagaaaaagaaaagaccaaugucucagaucaguggagucaagaaauugaugcacagcucuagucugacuaauucaaguaucccaagguuuggaguuaaaacugaacaagaagauguccuugccaaggaacuagaagaugugaacaaauggggucuucauguuuucagaauagcagaguugucugguaaccggcccuugacuguuaucaugcacaccauuuuucaggaacgggauuuauuaaaaacauuuaaaauuccaguagauacuuuaauuacauaucuuaugacucucgaagaccauuaccaugcugauguggccuaucacaacaauauccaugcugcagauguuguccagucuacucaugugcuauuaucuacaccugcuuuggaggcuguguuuacagauuuggagauucuugcagcaauuuuugccagugcaauacaugauguagaucauccugguguguccaaucaauuucugaucaauacaaacucugaacuugccuugauguacaaugauuccucagucuuagagaaccaucauuuggcugugggcuuuaaauugcuucaggaagaaaacugugacauuuuccagaauuugaccaaaaaacaaagacaaucuuuaaggaaaauggucauugacaucguacuugcaacagauaugucaaaacacaugaaucuacuggcugauuugaagacuaugguugaaacuaagaaagugacaagcucuggaguucuucuucuugauaauuauuccgauaggauucagguucuucagaauauggugcacugugcagaucugagcaacccaacaaagccucuccagcuguaccgccaguggacggaccggauaauggaggaguucuuccgccaaggagaccgagagagggaacguggcauggagauaagccccaugugugacaagcacaaugcuuccguggaaaaaucacaggugggcuucauagacuauauuguucauccccucugggagacaugggcagaccucguccacccugacgcccaggauauuuuggacacuuuggaggacaaucgugaaugguaccagagcacaaucccucagagccccucuccugcaccugaugacccagaggagggccggcagggucaaacugagaaauuccaguuugaacuaacuuuagaggaagauggugagucagacacggaaaaggacaguggcagucaaguggaagaagacacuagcugcagugacuccaagacucuuuguacucaagacucagagucuacugaaauuccccuugaugaacagguugaagaggaggcaguaggggaagaagaggaaagccagccugaagccugugucauagaugaucguucuccugacacguaacagugcaaaaacuuucaugccuuuuuuuuuuuuaaguagaaaaauuguuuccaaagugcaugucacaugccacaaccacggucacaccucacugucaucugccaggacguuuguugaacaaaacugaccuugacuacucaguccagcgcucaggaauaucguaaccaguuuuuucaccuccaugucauccgagcaagguggacaucuucacgaacagcguuuuuaacaagauuucagcuugguagagcugacaaagcagauaaaaucuacuccaaauuauuuucaagagagugugacucaucaggcagcccaaaaguuuauuggacuugggguuucuauuccuuuuuauuuguuugcaauauuuucagaagaaaggcauugcacagagugaacuuaauggacgaagcaacaaauaugucaagaacaggacauagcacgaaucuguuaccaguaggaggaggaugagccacagaaauugcauaauuuucuaauuucaagucuuccugauacaugacugaauagugugguucagugagcugcacugaccucuacauuuuguaugauauguaaaacagauuuuuuguagagcuuacuuuuauuauuaaauguauugagguauuauauuuaaaaaaaacuauguucagaacuucaucugccacugguuauuuuuuucuaaggaguaacuugcaaguuuucaguacaaaucugugcuacacuggauaaaaaucuaauuuaugaauuuuacuugcaccuuauaguucauagcaauuaacugauuuguagugauucauuguuuguuuuauauaccaaugacuuccauauuuuaaaagagaaaaacaacuuuauguugcaggaaacccuuuuuguaagucuuuauuauuuacuuugcauuuuguuucacucuuuccagauaagcagaguugcucuucaccaguguuuuucuucaugugcaaagugacuauuuguucuauaauacuuuuauguguguuauaucaaaugugucuuaagcuucaugcaaacucagucaucaguucguguugucugaagcaagugggagauauauaaauacccaguagcuaaaauggucagucuuuuuuagauguuuuccuacuuaguaucuccuaauaacguuuugcugugucacuagauguucauuucacaagugcaugucuuucuaauaauccacacauuucaugcucuaauaauccacacauuucaugcucauuuuuauuguuuuuacagccaguuauaguaagaaaaagguuuuuccccuugugcugcuuuauaauuuagcgugugucugaaccuuauccauguuugcuagaugaggucuugucaaauauaucacuaccauugucaccggugaaaagaaacagguaguuaaguuaggguuaacauucauuucaaccacgagguuguauaucaugacuagcuuuuacucuugguuuacagagaaaaguuaaacagccaacuaggcaguuuuuaagaauauuaacaauauauuaacaaacaccaauacaacuaauccuauuugguuuuaaugauuucaccaugggauuaagaacuauaucaggaacaucccugagaaacgguuuuaaguguagcaacuacucuuccuuaauggacagccacauaacguguaggaaguccuuuaucacuuauccucgauccauaagcauaucuugcagaggggaacuacuucuuuaaacacauggagggaaagaagaugaugccacuggcaccagaggguuaguacugugaugcauccuaaaauauuuauuauauugguaaaaauucugguuaaauaaaaaauuagagaucacucuuggcugauuucagcaccaggaacuguauuacaguuuuagagauuaauuccuaguguuuaccugauuauagcaguuggcaucauggggcauuuaauucugacuuuauccccacgucagccuuaauaaagucuucuuuaccuucucuaugaagacuuuaaagcccaaauaaucauuuuucacauugauauucaagaauugagauagauagaagccaaaguggguaucugacaaguggaaaaucaaacguuuaagaagaauuacaacucugaaaagcauuuauauguggaacuucucaaggagccuccuggggacuggaaaguaagucaucagccaggcaaaugacucaugcugaagagaguccccauuucaguccccugagaucuagcugaugcuuagauccuuugaaauaaaaauuaugucuuuauaacucugaucuuuuacauaaagcagaagaggaaucaacuaguuaauugcaagguuucuacucuguuuccucuguaaagaucagaugguaaucuuucaaauaagaaaaaaauaaagacguauguuugaccaaguaguuucacaagaauauuugggaacuuguuucuuuuaauuuuauuugucccugagugaagucuagaaagaaagguaaagagucuagaguuuauuccucuuuccaaaacauucucauuccucuccucccuacacuuaguauuucccccacagagugccuagaaucuuaauaaugaauaaaauaaaaagcagcaauaugucauuaacaaauccagaccugaaaggguaaaggguuuauaacugcacuaauaaagagaggcucuuuuuuuuucuuccaguuuguugguuuuuaaugguaccguguuguaaagauacccacuaauggacaaucaaauugcagaaaaggcucaauauccaagagacagggacuaaugcacuguacaaucugcuuauccuugcccuucucucuugccaaagugugcuucagaaauauauacugcuuuaaaaaagaauaaaagaauauccuuuuacaaguggcuuuacauuuccuaaaaugccauaagaaaaugcaauaucuggguacuguauggggaaaaaaauguccaaguuuguguaaaaccagugcauuucagcuugcaaguuacugaacacaauaaugcuguuuuaauuuuguuuuauaucaguuaaaauucacaauaauguagauagaacaaauuacagacaaggaaagaaaaaacuugaaugaaauggauuuuacagaaagcuuuaugauaauuuuugaaugcauuauuuauuuuuugugccaugcauuuuuuuucucaccaaaugaccuuaccuguaauacagucuuguuugucuguuuacaaccauguauuuauugcaauguacauacuguaauguuaauuguaaauuaucuguucuuauuaaaacaucaucccaugaugggaugguguugauauauuuggaaacucuuggugagagaaugaaugguguguauacauacucuguacauuuuucuuuucuccuguaauauagucuugucaccuuagagcuuguuuauggaagauucaagaaaacuauaaaauacuuaaagauauauaaauuuaaaaaaacauagcugcaggucuuuggucccagggcugugccuuaacuuuaaccaauauuuucuucuguuuugcugcauuugaaagguaacaguggagcuagggcugggcauuuuacauccaggcuuuuaauugauuagaauucugccaauagguggauuuuacaaaaccacagacaaccucugaaagauucugagacccuuuugagacagaagcucuuaaguacuucuugccagggagcagcacugcaugugugaugguuguuugccaucuguugaucaggaacuacuucagcuacuugcauuugauuauuuccuuuuuuuuuuuuuuuaacucggaaacacaacuggggaaauauauucuuucccagugauuauaaacaaucuuuuucuuuuuuuuaaguccuuuuggcuucuagagcucauaggaaaauggacuugauuugaaauuggagccagaguuuacucguguugguuaucuauucaucagcuuccugacauguuaagagaauacauuaaagagaaaauacuguuuuuuaauccuaaaauuuuucuuccacuaagauaaaccaaauguccuuacauauauguaaacccaucuauuuaaacgcaaagguggguugaugucaguuuacauagcagaaagcauucacuauccucuaagauuuguuucugcaaaacuuucauugcuuuagaauuuuaaaauuucaccuuguacaauggccagccccuaaagcaggaaacauuuauaauggauuauauggaaacauccucccaguacuugcccagcccuugaaucauguggcuuuucagugaaaggaaagauucuuuuucuaggaaaaaugagccuauuuuauuuuauuuuauuuuauuuuuugacacaaacuguagauuuuagcagcccuggcccaaaggaauuugauuacuuuuguuuuaaacaguacaaaggggacacuauaauuacaaaaacauccuuaacugauuugaguuguuuuuauuucuuuggauauauuuucagagugguaaauugugugugagaauuacaaaugauuauucuuuuagugguuucuuagccucucuuacagcccacggggauaguacuguacaucaauaccuucauaugaaauuuuuauaugcaaugaaaauaaaagcauggguugauucugccuauuuaugacucaaucuuuuacaaauaaaagauuauucauuuuaaauuauaguucaaucagcaugucucuuaggauacugaacgugguugaaaugaaaggauagugacaucauaaguuaguacugauauucauaaccaaauaaagccaacuugaguaauuuugcuacauuaaaaauuaccaaaauuacuuagauggccuauaagauuaagcaugguguuuucuaagcaagcuuugaaaggggccuuccauacuuacuuaauugaauauucugggauauugaaaauuauucagauacuugacaauuauuuuugguuaccuacuccgcaaacuacaaaguuuuaaggacucaacaauaaguuaaugagacacaguguuugcuuucauggagcuuacagucuggaggggacaaaggcuuaaacaauacucauauaauuauauaugugaucaguacaaugaaggagcucagugggguaaauaagcaggaaccugaacuugaucuguuccggagggccacagaaggcuuccuugaggccuugagaaagugauuugcaucugaguucugaaggauuguaagagguaacuagggaaaaaguugacaggaagaggaaggggauccagacaagaaacauuugcaaagaucuugaggcauaaaugagcuugagacaucuggagaaacugaggaaaagugagagaguaggcagggccuggagccgcagagccauugcuaaccauccugugugagauaucccccauucuguagcuuuauucucauaacccugcucaauuuucuuuauaacacuucucacagauuuauauacguguuuguuuuuguuaucugucucucccaccagaccacagcuccaugagagcaaggucuuugcuuaccaauauaucacuagcacuuaaaacuaugccugguacacaguagguucuuaauauguguugaauauagccaucaaauugauauuggauauaauucaaucugauaagauauuuugagauauuaaagaguuuuuaacuugauaccauaaaaaaaaaaaaaaaaa

SEQ ID NO: 60 - RNA, 8130 nt, Homo_Sapiens
agauuauagcccagcguacgagaagcacgaguccuauaguuggcguacccugaggccugccaguuccugccuuaaugcauauguagucguaauugaguucugacacggccuuggauguuucuguccuaaauagcugacauugcaucuucaagacugucauuccaguuggcuuuugaguggauacgugcagugagaucauugacacuggaaacacuaguucccauuuuaauuacuuaaaacaccacgaugaaaagaaauaccugugauuugcuuucucggagcaaaagugccucugaggaaacacuacauuccaguaaugaagaggaagacccuuuccgcggaauggaacccuaucuuguccggagacuuucaugucgcaauauucagcuucccccucucgccuucagacaguuggaacaagcugacuugaaaagugaaucagagaacauucaacgaccaaccagccucccccugaagauucugccgcugauugcuaucacuucugcagaauccagugguuuugauguggacaauggcacaucugcgggacggagucccuuggaucccaugaccagcccaggauccgggcuaauucuccaagcaaauuuuguccacagucaacgacgggaguccuuccuguaucgauccgacagcgauuaugaccucucuccaaagucuaugucccggaacuccuccauugccagugauauacacggagaugacuugauugugacuccauuugcucaggucuuggccagucugcgaacuguacgaaacaacuuugcugcauuaacuaauuugcaagaucgagcaccuagcaaaagaucacccaugugcaaccaaccauccaucaacaaagccaccauaacagaggaggccuaccagaaacuggccagcgagacccuggaggagcuggacuggugucuggaccagcuagagacccuacagaccaggcacuccgucagugagauggccuccaacaaguuuaaaaggaugcuuaaucgggagcucacccaucucucugaaaugagucggucuggaaaucaagugucagaguuuauaucaaacacauucuuagauaagcaacaugaaguggaaauuccuucuccaacucagaaggaaaaggagaaaaagaaaagaccaaugucucagaucaguggagucaagaaauugaugcacagcucuagucugacuaauucaaguaucccaagguuuggaguuaaaacugaacaagaagauguccuugccaaggaacuagaagaugugaacaaauggggucuucauguuuucagaauagcagaguugucugguaaccggcccuugacuguuaucaugcacaccauuuuucaggaacgggauuuauuaaaaacauuuaaaauuccaguagauacuuuaauuacauaucuuaugacucucgaagaccauuaccaugcugauguggccuaucacaacaauauccaugcugcagauguuguccagucuacucaugugcuauuaucuacaccugcuuuggaggcuguguuuacagauuuggagauucuugcagcaauuuuugccagugcaauacaugauguagaucauccugguguguccaaucaauuucugaucaauacaaacucugaacuugccuugauguacaaugauuccucagucuuagagaaccaucauuuggcugugggcuuuaaauugcuucaggaagaaaacugugacauuuuccagaauuugaccaaaaaacaaagacaaucuuuaaggaaaauggucauugacaucguacuugcaacagauaugucaaaacacaugaaucuacuggcugauuugaagacuaugguugaaacuaagaaagugacaagcucuggaguucuucuucuugauaauuauuccgauaggauucagguucuucagaauauggugcacugugcagaucugagcaacccaacaaagccucuccagcuguaccgccaguggacggaccggauaauggaggaguucuuccgccaaggagaccgagagagggaacguggcauggagauaagccccaugugugacaagcacaaugcuuccguggaaaaaucacaggugggcuucauagacuauauuguucauccccucugggagacaugggcagaccucguccacccugacgcccaggauauuuuggacacuuuggaggacaaucgugaaugguaccagagcacaaucccucagagccccucuccugcaccugaugacccagaggagggccggcagggucaaacugagaaauuccaguuugaacuaacuuuagaggaagauggugagucagacacggaaaaggacaguggcagucaaguggaagaagacacuagcugcagugacuccaagacucuuuguacucaagacucagagucuacugaaauuccccuugaugaacagguugaagaggaggcaguaggggaagaagaggaaagccagccugaagccugugucauagaugaucguucuccugacacguaacagugcaaaaacuuucaugccuuuuuuuuuuuuaaguagaaaaauuguuuccaaagugcaugucacaugccacaaccacggucacaccucacugucaucugccaggacguuuguugaacaaaacugaccuugacuacucaguccagcgcucaggaauaucguaaccaguuuuuucaccuccaugucauccgagcaagguggacaucuucacgaacagcguuuuuaacaagauuucagcuugguagagcugacaaagcagauaaaaucuacuccaaauuauuuucaagagagugugacucaucaggcagcccaaaaguuuauuggacuugggguuucuauuccuuuuuauuuguuugcaauauuuucagaagaaaggcauugcacagagugaacuuaauggacgaagcaacaaauaugucaagaacaggacauagcacgaaucuguuaccaguaggaggaggaugagccacagaaauugcauaauuuucuaauuucaagucuuccugauacaugacugaauagugugguucagugagcugcacugaccucuacauuuuguaugauauguaaaacagauuuuuuguagagcuuacuuuuauuauuaaauguauugagguauuauauuuaaaaaaaacuauguucagaacuucaucugccacugguuauuuuuuucuaaggaguaacuugcaaguuuucaguacaaaucugugcuacacuggauaaaaaucuaauuuaugaauuuuacuugcaccuuauaguucauagcaauuaacugauuuguagugauucauuguuuguuuuauauaccaaugacuuccauauuuuaaaagagaaaaacaacuuuauguugcaggaaacccuuuuuguaagucuuuauuauuuacuuugcauuuuguuucacucuuuccagauaagcagaguugcucuucaccaguguuuuucuucaugugcaaagugacuauuuguucuauaauacuuuuauguguguuauaucaaaugugucuuaagcuucaugcaaacucagucaucaguucguguugucugaagcaagugggagauauauaaauacccaguagcuaaaauggucagucuuuuuuagauguuuuccuacuuaguaucuccuaauaacguuuugcugugucacuagauguucauuucacaagugcaugucuuucuaauaauccacacauuucaugcucuaauaauccacacauuucaugcucauuuuuauuguuuuuacagccaguuauaguaagaaaaagguuuuuccccuugugcugcuuuauaauuuagcgugugucugaaccuuauccauguuugcuagaugaggucuugucaaauauaucacuaccauugucaccggugaaaagaaacagguaguuaaguuaggguuaacauucauuucaaccacgagguuguauaucaugacuagcuuuuacucuugguuuacagagaaaaguuaaacagccaacuaggcaguuuuuaagaauauuaacaauauauuaacaaacaccaauacaacuaauccuauuugguuuuaaugauuucaccaugggauuaagaacuauaucaggaacaucccugagaaacgguuuuaaguguagcaacuacucuuccuuaauggacagccacauaacguguaggaaguccuuuaucacuuauccucgauccauaagcauaucuugcagaggggaacuacuucuuuaaacacauggagggaaagaagaugaugccacuggcaccagaggguuaguacugugaugcauccuaaaauauuuauuauauugguaaaaauucugguuaaauaaaaaauuagagaucacucuuggcugauuucagcaccaggaacuguauuacaguuuuagagauuaauuccuaguguuuaccugauuauagcaguuggcaucauggggcauuuaauucugacuuuauccccacgucagccuuaauaaagucuucuuuaccuucucuaugaagacuuuaaagcccaaauaaucauuuuucacauugauauucaagaauugagauagauagaagccaaaguggguaucugacaaguggaaaaucaaacguuuaagaagaauuacaacucugaaaagcauuuauauguggaacuucucaaggagccuccuggggacuggaaaguaagucaucagccaggcaaaugacucaugcugaagagaguccccauuucaguccccugagaucuagcugaugcuuagauccuuugaaauaaaaauuaugucuuuauaacucugaucuuuuacauaaagcagaagaggaaucaacuaguuaauugcaagguuucuacucuguuuccucuguaaagaucagaugguaaucuuucaaauaagaaaaaaauaaagacguauguuugaccaaguaguuucacaagaauauuugggaacuuguuucuuuuaauuuuauuugucccugagugaagucuagaaagaaagguaaagagucuagaguuuauuccucuuuccaaaacauucucauuccucuccucccuacacuuaguauuucccccacagagugccuagaaucuuaauaaugaauaaaauaaaaagcagcaauaugucauuaacaaauccagaccugaaaggguaaaggguuuauaacugcacuaauaaagagaggcucuuuuuuuuucuuccaguuuguugguuuuuaaugguaccguguuguaaagauacccacuaauggacaaucaaauugcagaaaaggcucaauauccaagagacagggacuaaugcacuguacaaucugcuuauccuugcccuucucucuugccaaagugugcuucagaaauauauacugcuuuaaaaaagaauaaaagaauauccuuuuacaaguggcuuuacauuuccuaaaaugccauaagaaaaugcaauaucuggguacuguauggggaaaaaaauguccaaguuuguguaaaaccagugcauuucagcuugcaaguuacugaacacaauaaugcuguuuuaauuuuguuuuauaucaguuaaaauucacaauaauguagauagaacaaauuacagacaaggaaagaaaaaacuugaaugaaauggauuuuacagaaagcuuuaugauaauuuuugaaugcauuauuuauuuuuugugccaugcauuuuuuuucucaccaaaugaccuuaccuguaauacagucuuguuugucuguuuacaaccauguauuuauugcaauguacauacuguaauguuaauuguaaauuaucuguucuuauuaaaacaucaucccaugaugggaugguguugauauauuuggaaacucuuggugagagaaugaaugguguguauacauacucuguacauuuuucuuuucuccuguaauauagucuugucaccuuagagcuuguuuauggaagauucaagaaaacuauaaaauacuuaaagauauauaaauuuaaaaaaacauagcugcaggucuuuggucccagggcugugccuuaacuuuaaccaauauuuucuucuguuuugcugcauuugaaagguaacaguggagcuagggcugggcauuuuacauccaggcuuuuaauugauuagaauucugccaauagguggauuuuacaaaaccacagacaaccucugaaagauucugagacccuuuugagacagaagcucuuaaguacuucuugccagggagcagcacugcaugugugaugguuguuugccaucuguugaucaggaacuacuucagcuacuugcauuugauuauuuccuuuuuuuuuuuuuuuaacucggaaacacaacuggggaaauauauucuuucccagugauuauaaacaaucuuuuucuuuuuuuuaaguccuuuuggcuucuagagcucauaggaaaauggacuugauuugaaauuggagccagaguuuacucguguugguuaucuauucaucagcuuccugacauguuaagagaauacauuaaagagaaaauacuguuuuuuaauccuaaaauuuuucuuccacuaagauaaaccaaauguccuuacauauauguaaacccaucuauuuaaacgcaaagguggguugaugucaguuuacauagcagaaagcauucacuauccucuaagauuuguuucugcaaaacuuucauugcuuuagaauuuuaaaauuucaccuuguacaauggccagccccuaaagcaggaaacauuuauaauggauuauauggaaacauccucccaguacuugcccagcccuugaaucauguggcuuuucagugaaaggaaagauucuuuuucuaggaaaaaugagccuauuuuauuuuauuuuauuuuauuuuuugacacaaacuguagauuuuagcagcccuggcccaaaggaauuugauuacuuuuguuuuaaacaguacaaaggggacacuauaauuacaaaaacauccuuaacugauuugaguuguuuuuauuucuuuggauauauuuucagagugguaaauugugugugagaauuacaaaugauuauucuuuuagugguuucuuagccucucuuacagcccacggggauaguacuguacaucaauaccuucauaugaaauuuuuauaugcaaugaaaauaaaagcauggguugauucugccuauuuaugacucaaucuuuuacaaauaaaagauuauucauuuuaaauuauaguucaaucagcaugucucuuaggauacugaacgugguugaaaugaaaggauagugacaucauaaguuaguacugauauucauaaccaaauaaagccaacuugaguaauuuugcuacauuaaaaauuaccaaaauuacuuagauggccuauaagauuaagcaugguguuuucuaagcaagcuuugaaaggggccuuccauacuuacuuaauugaauauucugggauauugaaaauuauucagauacuugacaauuauuuuugguuaccuacuccgcaaacuacaaaguuuuaaggacucaacaauaaguuaaugagacacaguguuugcuuucauggagcuuacagucuggaggggacaaaggcuuaaacaauacucauauaauuauauaugugaucaguacaaugaaggagcucagugggguaaauaagcaggaaccugaacuugaucuguuccggagggccacagaaggcuuccuugaggccuugagaaagugauuugcaucugaguucugaaggauuguaagagguaacuagggaaaaaguugacaggaagaggaaggggauccagacaagaaacauuugcaaagaucuugaggcauaaaugagcuugagacaucuggagaaacugaggaaaagugagagaguaggcagggccuggagccgcagagccauugcuaaccauccugugugagauaucccccauucuguagcuuuauucucauaacccugcucaauuuucuuuauaacacuucucacagauuuauauacguguuuguuuuuguuaucugucucucccaccagaccacagcuccaugagagcaaggucuuugcuuaccaauauaucacuagcacuuaaaacuaugccugguacacaguagguucuuaauauguguugaauauagccaucaaauugauauuggauauaauucaaucugauaagauauuuugagauauuaaagaguuuuuaacuugauaccauaaaaaaaaaaaaaaaa

SEQ ID NO: 61 - RNA, 1354 nt, Homo_Sapiens
gcagcccgccggcgauuggggcgcgcgcgccuccuucgguuuggggcuaauuauaaaguggcuccagcagccguuaagccccgggacggcgaggcaggcgcucagagccccgcagccuggcccgugaccccgcagagacgcugaggaccgcgacgagucgugucugaacccggcuuuuccaauuggccugcuccauccgaacagcgucaacuccauggcgcgguuccugacacuuugcacuuggcugcuguugcucggccccgggcuccuggcgaccgugcgggccgaaugcagccaggauugcgcgacgugcagcuaccgccuagugcgcccggccgacaucaacuuccuggcuugcguaauggaaugugaagguaaacugccuucucugaaaauuugggaaaccugcaaggagcuccugcagcuguccaaaccagagcuuccucaagauggcaccagcacccucagagaaaauagcaaaccggaagaaagccauuugcuagccaaaagguaugggggcuucaugaaaagguauggaggcuucaugaagaaaauggaugagcuuuaucccauggagccagaagaagaggccaauggaagugagauccucgccaagcgguaugggggcuucaugaagaaggaugcagaggaggacgacucgcuggccaauuccucagaccugcuaaaagagcuucuggaaacaggggacaaccgagagcguagccaccaccaggauggcagugauaaugaggaagaagugagcaagagauaugggggcuucaugagaggcuuaaagagaagcccccaacuggaagaugaagccaaagagcugcagaagcgauaugggggcuucaugagaagaguaggucgcccagagugguggauggacuaccagaaacgguauggagguuuccugaagcgcuuugccgaggcucugcccuccgacgaagaaggcgaaaguuacuccaaagaaguuccugaaauggaaaaaagauacggaggauuuaugagauuuuaauaucuuuucccacuaguggccccaggccccagcaagccucccuccauccuccagugggaaacuguugaugguguuuuauugucauguguugcuugccuuguauaguugacuucauugucuggauaacuauacaaccugaaaacugucauuucagguucugugcucuuuuuggagucuuuaagcucaguauuagucuauugcagcuaucucguuuucaugcuaaaauaguuuuuguuaucuugucucuuauuuuugacaaacaucaauaaaugcuuacuuguauauagagauaauaaaccuauuaccccaagugcauaaaaaaaaaaaaaaaaaaaa

SEQ ID NO: 62 - RNA, 1221 nt, Homo_Sapiens
gucgcggcgaggguccugccgagggaccccguucugcgcccaggcaggcucgaagcacgcgucccucucuccucgcaguccauggcgcgguuccugacacuuugcacuuggcugcuguugcucggccccgggcuccuggcgaccgugcgggccgaaugcagccaggauugcgcgacgugcagcuaccgccuagugcgcccggccgacaucaacuuccuggcuugcguaauggaaugugaagguaaacugccuucucugaaaauuugggaaaccugcaaggagcuccugcagcuguccaaaccagagcuuccucaagauggcaccagcacccucagagaaaauagcaaaccggaagaaagccauuugcuagccaaaagguaugggggcuucaugaaaagguauggaggcuucaugaagaaaauggaugagcuuuaucccauggagccagaagaagaggccaauggaagugagauccucgccaagcgguaugggggcuucaugaagaaggaugcagaggaggacgacucgcuggccaauuccucagaccugcuaaaagagcuucuggaaacaggggacaaccgagagcguagccaccaccaggauggcagugauaaugaggaagaagugagcaagagauaugggggcuucaugagaggcuuaaagagaagcccccaacuggaagaugaagccaaagagcugcagaagcgauaugggggcuucaugagaagaguaggucgcccagagugguggauggacuaccagaaacgguauggagguuuccugaagcgcuuugccgaggcucugcccuccgacgaagaaggcgaaaguuacuccaaagaaguuccugaaauggaaaaaagauacggaggauuuaugagauuuuaauaucuuuucccacuaguggccccaggccccagcaagccucccuccauccuccagugggaaacuguugaugguguuuuauugucauguguugcuugccuuguauaguugacuucauugucuggauaacuauacaaccugaaaacugucauuucagguucugugcucuuuuuggagucuuuaagcucaguauuagucuauugcagcuaucucguuuucaugcuaaaauaguuuuuguuaucuugucucuuauuuuugacaaacaucaauaaaugcuuacuuguauauagagauaauaaaccuauuaccccaagugcauaaaaaaaaaaaaaaaaaaaa

SEQ ID NO: 63 - RNA, 4827 nt, Homo_Sapiens
caaucaggaugcuggggcucggagaugaugggcggccgccuccucacuggagggauuccuggagaagcugcaguguggggaugcucuagaccgaguacugcccccagugucuuuccaccuccuccugcagcagcggcagcggcagcagcaguuagcagcggcaacuugaggcugcaccccgggcaaguccccaggguggugcucagccgagaggggggcuuggcgccccgaagggguguguguagggugggggcgaccagcugggaccagcugguggcccuggaaaaccucccacacacccacacccacacaccccuuuuguguugcaggcugccccuccaagagcggaggcagcgagaguacgcgugugccucgcgccgguccacgcggggagagcacuggggaccgagacccggcaccaccucccgguccgcccuccagggaaaacgggaaaacuagcaagagcuagcaagaacuagcaagagcuugaacaaacgccuggacucagauuggaagacugcucauuugucuacugccucauuccuggaaauugcacuggaacugucugauuaagaaaaacagaauaauucugaaagaaagaaaacaaagaaaaacauacuccagaauuccuaauagaacacuucaccugaaccuaaaauggugagcgagagucaccaugaggcccuggcagccccgccugucaccacugucgcgacuguucugccaagcaacgccacagagccagccaguccuggagaaggaaaggaagaugcauuuucuaagcugaaggagaaguuuaugaaugaguugcauaaaauuccauugccaccgugggccuuaauugcaauagccauagucgcaguccuuuuaguccugaccugcugcuuuuguaucuguaagaaauguuuguucaaaaagaaaaacaagaagaagggaaaggaaaaaggagggaagaaugccauuaacaugaaagauguaaaagacuuagggaagacgaugaaagaucaggcccucaaggaugaugaugcugaaacuggauugacagauggagaagaaaaagaagaacccaaagaagaggagaaacugggaaaacuucaguauucacuggauuaugauuuccaaaauaaccagcugcugguagggaucauucaggcugccgaacugcccgccuuggacauggggggcacaucugauccuuacgugaaaguguuucugcuaccugauaagaagaagaaauuugagacaaaaguccaccgaaaaacccuuaauccugucuucaaugagcaauuuacuuucaagguaccauacucggaauuggguggcaaaacccuagugauggcuguauaugauuuugaucguuucucuaagcaugacaucauuggagaauuuaaagucccuaugaacacaguggauuuuggccauguaacugaggaauggcgugaccugcaaagugcugagaaggaagagcaagagaaauugggugauaucugcuucucccuucgcuacguaccuacugcugguaagcugacuguugucauucuggaggcaaagaaccugaagaagauggauguggguggcuuauccgauccuuaugugaagauucaucugaugcagaaugguaagaggcugaagaagaaaaagacaacaauuaaaaagaacacacuuaaccccuacuacaaugagucauucagcuuugaaguaccuuuugaacaaauccagaaagugcagguggugguaacuguuuuggacuaugacaagauuggcaagaacgaugccaucggcaaagucuuugugggcuacaacagcaccggcgcggagcugcgacacuggucagacaugcuggccaaccccaggcgaccuauugcccaguggcacacccugcagguagaggaggaaguugaugccaugcuggccgucaagaaguaaaggaaagaagaagccuuucugcauuugcccauauagugcucuuuagccaguaucuguaaauaccucaguaauauggguccuuucauuuuuccagccaugcauuccuaacacaauucagugguacuuggaauccuguuuuaauuugcacaaauuuaaauguagagagccccuaaguccuucaucauaccacugcccuccaaaucuacucuucuuuuaagcaauaugauguguagauagagcaugaaugaaauuauuuauuguaucacacuguuguauauaccaguaugcuaaagauuuauuucuaguuuguguauuuguauguuguaagcguuuccuaaucuguguauaucuagauguuuuuaauaagauguucuauuuuaaacuauguaaauugacugagauauaggagagcugauaauauauuauacgguaaauauaguaucgucugcauuccagcaaaaauaucaacucguaaggcacuaguacaguuaaacugacaucuuaaaggacaacuuaaaccugagcuuucuauugaaucauuugaguaccaagauaaacuuacaccacauacuuggugggugaauccaauuuuguagaauuccuacacaggcaaaauagcaugaucugagcagcagcauccaggcugaccucaaggaagcauagccacaaaacagaauagcaccugucuguacauauuuacaaagcuaaaauaauggcuucacucuuauauuugaggaagcaacugaacaggagucaaugauuucauauuacugcauauagaauaacaacaagguguuccgugugugugugugugugugugugugugugugugugcacauuuguuuggggaugggggagaagaagcuaaggggagaagucaacauuuaugaaauauugccugacuauuuaaaaagaaaaaaguagcucuccauuaucaccuuuauacaaaauguacauccugugaauucuguuccagauuucacaccuacaauaauuccaaaagguuugcacauuagaguuuguaacaaaauauuuuauuauauaaaaccagguuagaaggaaugcaggauauuuuuaacacaacaaucugugcuuauuacacaaaauuacuuugugguaaacagacaguauuguaaucccaucaaaagaugaaagaaaaacaaaaacaaaaaccaacaacaauuagccauaguucugaaugcacuucaauuaagccaaaacagacagcuagugaucuuuuuauaugcucuuuuuacuuaaguuuuaauuuguccuuuaaaaaaaggugaaacaaaccaagaacaaguucuagaaaacugaagcaaccucuuauguauacuagaugcuugauuuaggaggaguuuuuaaacguuuucaauguuauuauguaguaaaugacacuauuaugaagcuacuagucauuccauaagagucuuaaaggacugcucuguguaacacugugacugccgugugugcuuagacccguaguuuccucaguggauagcacucaauuuauuccguagugauauuguaacaauacugccauucccuucuacugcacugcccaagguguguguagcacaaacaguucucauuacaaaggaccaauucagaacugaaaagcuaugcauaggacaaggaagauacauagaaugggguggaacacagcauuuugucaagcacugugcaauauuccauauuuuuccccacuaugguagacaaccauuucguggaagggcagccuauuaucccacacugcaucuagccuuuugucccauucacuucugugauccauuuuaauuuccaggccacaagacaguagugaugcucugaaaugaaaguuugucuucacaaauaucaaaacaaaauggaggaaaacuaagcauuggccucauguucagucuucaggauaucacaccacgucuuuucaaaaacuaaagagaauucaaaaagggcugaugguaggcuuugaacaugggguuggcuguuucccaguaaaacuggaauuccugucguuacuguuuccuuaucaaagaaggggcaagcucuuuugccuuuuaggccagacauagcaaacgcuuuauaauuggcauagacauaaaggauaaaaggaaaauaaccgucugccgaugguccguacuucuuaaaaaacauagguaauagaaaauauacacaagucagaaugugaaauuaaauaaugguuugaacagaaaauucaaacaagacucuuuccaauuuaaagggccaaacccuaccaaagagagggaguugacuggcuuuuaaaaaguauuuaaauaccacaaaugacauuuaauuucacuguauucagcuuuaaguuguucacaaugaaaccacacuuucaaacaagcagguucaagcugcugaauagacauuauuucuugcauuaaaauaccacuaaugcauucucuugcaacacugccagacaugggauugucaccauagaauuaguugguacuaugccaucuuucacucuuucacaagucagugauggaaccugcuuuaugaccaagauucauccucaaauaagccacauguacccuucugacaaagcuguguaaaguauuagaaucugaugcucuagaaagauccuaguugccuuuguguauauuuacugccugcuugaguguuucuauguguggguuuucccuguaucuuguagaaauguugggguguuuuccucugccauauggcucguggccugcgagccaacuauuucagcuguauuuuaccuucauuuuugaugaggugauuuaaauuuuguuucacuuuguguagugaauuccacaguaguuuucugauuguuguuaaaaaugacuuaacauauuacacagauauucaauaaaaauguuuuauuuccuguugaaaaaaaaaaaaaaaaaa

SEQ ID NO: 64 - RNA, 4841 nt, Homo_Sapiens
aucucggcuccaccgcacccuucgcgggaaguccccaggcuuccagcaaagcucagcuuaucccgcccccgcuuccaacccggaaccccagaagaacagcaugaugagccuccggcagccaggugggccaccuccccgcggcucaguuugaggacacuugugcggaacccuuucacauccccacccuacccagcuuucacaacuccgccggguuaaauggccaaagacaaacuucuaccucuccuguccccggucccagcuuuucaaaaacccacagcuggcgaacccacacacaucgaaacuccuaggucgcuguugcagucugggcaugcucaguaucagggcugccccuccaagagcggaggcagcgagaguacgcgugugccucgcgccgguccacgcggggagagcacuggggaccgagacccggcaccaccucccgguccgcccuccagggaaaacgggaaaacuagcaagagcuagcaagaacuagcaagagcuugaacaaacgccuggacucagauuggaagacugcucauuugucuacugccucauuccuggaaauugcacuggaacugucugauuaagaaaaacagaauaauucugaaagaaagaaaacaaagaaaaacauacuccagaauuccuaauagaacacuucaccugaaccuaaaauggugagcgagagucaccaugaggcccuggcagccccgccugucaccacugucgcgacuguucugccaagcaacgccacagagccagccaguccuggagaaggaaaggaagaugcauuuucuaagcugaaggagaaguuuaugaaugaguugcauaaaauuccauugccaccgugggccuuaauugcaauagccauagucgcaguccuuuuaguccugaccugcugcuuuuguaucuguaagaaauguuuguucaaaaagaaaaacaagaagaagggaaaggaaaaaggagggaagaaugccauuaacaugaaagauguaaaagacuuagggaagacgaugaaagaucaggcccucaaggaugaugaugcugaaacuggauugacagauggagaagaaaaagaagaacccaaagaagaggagaaacugggaaaacuucaguauucacuggauuaugauuuccaaaauaaccagcugcugguagggaucauucaggcugccgaacugcccgccuuggacauggggggcacaucugauccuuacgugaaaguguuucugcuaccugauaagaagaagaaauuugagacaaaaguccaccgaaaaacccuuaauccugucuucaaugagcaauuuacuuucaagguaccauacucggaauuggguggcaaaacccuagugauggcuguauaugauuuugaucguuucucuaagcaugacaucauuggagaauuuaaagucccuaugaacacaguggauuuuggccauguaacugaggaauggcgugaccugcaaagugcugagaaggaagagcaagagaaauugggugauaucugcuucucccuucgcuacguaccuacugcugguaagcugacuguugucauucuggaggcaaagaaccugaagaagauggauguggguggcuuauccgauccuuaugugaagauucaucugaugcagaaugguaagaggcugaagaagaaaaagacaacaauuaaaaagaacacacuuaaccccuacuacaaugagucauucagcuuugaaguaccuuuugaacaaauccagaaagugcagguggugguaacuguuuuggacuaugacaagauuggcaagaacgaugccaucggcaaagucuuugugggcuacaacagcaccggcgcggagcugcgacacuggucagacaugcuggccaaccccaggcgaccuauugcccaguggcacacccugcagguagaggaggaaguugaugccaugcuggccgucaagaaguaaaggaaagaagaagccuuucugcauuugcccauauagugcucuuuagccaguaucuguaaauaccucaguaauauggguccuuucauuuuuccagccaugcauuccuaacacaauucagugguacuuggaauccuguuuuaauuugcacaaauuuaaauguagagagccccuaaguccuucaucauaccacugcccuccaaaucuacucuucuuuuaagcaauaugauguguagauagagcaugaaugaaauuauuuauuguaucacacuguuguauauaccaguaugcuaaagauuuauuucuaguuuguguauuuguauguuguaagcguuuccuaaucuguguauaucuagauguuuuuaauaagauguucuauuuuaaacuauguaaauugacugagauauaggagagcugauaauauauuauacgguaaauauaguaucgucugcauuccagcaaaaauaucaacucguaaggcacuaguacaguuaaacugacaucuuaaaggacaacuuaaaccugagcuuucuauugaaucauuugaguaccaagauaaacuuacaccacauacuuggugggugaauccaauuuuguagaauuccuacacaggcaaaauagcaugaucugagcagcagcauccaggcugaccucaaggaagcauagccacaaaacagaauagcaccugucuguacauauuuacaaagcuaaaauaauggcuucacucuuauauuugaggaagcaacugaacaggagucaaugauuucauauuacugcauauagaauaacaacaagguguuccgugugugugugugugugugugugugugugugugugcacauuuguuuggggaugggggagaagaagcuaaggggagaagucaacauuuaugaaauauugccugacuauuuaaaaagaaaaaaguagcucuccauuaucaccuuuauacaaaauguacauccugugaauucuguuccagauuucacaccuacaauaauuccaaaagguuugcacauuagaguuuguaacaaaauauuuuauuauauaaaaccagguuagaaggaaugcaggauauuuuuaacacaacaaucugugcuuauuacacaaaauuacuuugugguaaacagacaguauuguaaucccaucaaaagaugaaagaaaaacaaaaacaaaaaccaacaacaauuagccauaguucugaaugcacuucaauuaagccaaaacagacagcuagugaucuuuuuauaugcucuuuuuacuuaaguuuuaauuuguccuuuaaaaaaaggugaaacaaaccaagaacaaguucuagaaaacugaagcaaccucuuauguauacuagaugcuugauuuaggaggaguuuuuaaacguuuucaauguuauuauguaguaaaugacacuauuaugaagcuacuagucauuccauaagagucuuaaaggacugcucuguguaacacugugacugccgugugugcuuagacccguaguuuccucaguggauagcacucaauuuauuccguagugauauuguaacaauacugccauucccuucuacugcacugcccaagguguguguagcacaaacaguucucauuacaaaggaccaauucagaacugaaaagcuaugcauaggacaaggaagauacauagaaugggguggaacacagcauuuugucaagcacugugcaauauuccauauuuuuccccacuaugguagacaaccauuucguggaagggcagccuauuaucccacacugcaucuagccuuuugucccauucacuucugugauccauuuuaauuuccaggccacaagacaguagugaugcucugaaaugaaaguuugucuucacaaauaucaaaacaaaauggaggaaaacuaagcauuggccucauguucagucuucaggauaucacaccacgucuuuucaaaaacuaaagagaauucaaaaagggcugaugguaggcuuugaacaugggguuggcuguuucccaguaaaacuggaauuccugucguuacuguuuccuuaucaaagaaggggcaagcucuuuugccuuuuaggccagacauagcaaacgcuuuauaauuggcauagacauaaaggauaaaaggaaaauaaccgucugccgaugguccguacuucuuaaaaaacauagguaauagaaaauauacacaagucagaaugugaaauuaaauaaugguuugaacagaaaauucaaacaagacucuuuccaauuuaaagggccaaacccuaccaaagagagggaguugacuggcuuuuaaaaaguauuuaaauaccacaaaugacauuuaauuucacuguauucagcuuuaaguuguucacaaugaaaccacacuuucaaacaagcagguucaagcugcugaauagacauuauuucuugcauuaaaauaccacuaaugcauucucuugcaacacugccagacaugggauugucaccauagaauuaguugguacuaugccaucuuucacucuuucacaagucagugauggaaccugcuuuaugaccaagauucauccucaaauaagccacauguacccuucugacaaagcuguguaaaguauuagaaucugaugcucuagaaagauccuaguugccuuuguguauauuuacugccugcuugaguguuucuauguguggguuuucccuguaucuuguagaaauguugggguguuuuccucugccauauggcucguggccugcgagccaacuauuucagcuguauuuuaccuucauuuuugaugaggugauuuaaauuuuguuucacuuuguguagugaauuccacaguaguuuucugauuguuguuaaaaaugacuuaacauauuacacagauauucaauaaaaauguuuuauuuccuguugaaaaaaaaaaaaaaaaaa

SEQ ID NO: 65 - RNA, 4427 nt, Homo_Sapiens
accaccaagaauaaaauaguuguuuguccccuacaguagaacaaguuugcccauucauccuugugauagauaugcaugcaaaaccaaaaugaaaucaaauccccacagauggcucguaagucaaaaacacuguuuaauucuuucacugcaucccuuugggaagccuggcccuugaaaaacagaauaauucugaaagaaagaaaacaaagaaaaacauacuccagaauuccuaauagaacacuucaccugaaccuaaaauggugagcgagagucaccaugaggcccuggcagccccgccugucaccacugucgcgacuguucugccaagcaacgccacagagccagccaguccuggagaaggaaaggaagaugcauuuucuaagcugaaggagaaguuuaugaaugaguugcauaaaauuccauugccaccgugggccuuaauugcaauagccauagucgcaguccuuuuaguccugaccugcugcuuuuguaucuguaagaaauguuuguucaaaaagaaaaacaagaagaagggaaaggaaaaaggagggaagaaugccauuaacaugaaagauguaaaagacuuagggaagacgaugaaagaucaggcccucaaggaugaugaugcugaaacuggauugacagauggagaagaaaaagaagaacccaaagaagaggagaaacugggaaaacuucaguauucacuggauuaugauuuccaaaauaaccagcugcugguagggaucauucaggcugccgaacugcccgccuuggacauggggggcacaucugauccuuacgugaaaguguuucugcuaccugauaagaagaagaaauuugagacaaaaguccaccgaaaaacccuuaauccugucuucaaugagcaauuuacuuucaagguaccauacucggaauuggguggcaaaacccuagugauggcuguauaugauuuugaucguuucucuaagcaugacaucauuggagaauuuaaagucccuaugaacacaguggauuuuggccauguaacugaggaauggcgugaccugcaaagugcugagaaggaagagcaagagaaauugggugauaucugcuucucccuucgcuacguaccuacugcugguaagcugacuguugucauucuggaggcaaagaaccugaagaagauggauguggguggcuuauccgauccuuaugugaagauucaucugaugcagaaugguaagaggcugaagaagaaaaagacaacaauuaaaaagaacacacuuaaccccuacuacaaugagucauucagcuuugaaguaccuuuugaacaaauccagaaagugcagguggugguaacuguuuuggacuaugacaagauuggcaagaacgaugccaucggcaaagucuuugugggcuacaacagcaccggcgcggagcugcgacacuggucagacaugcuggccaaccccaggcgaccuauugcccaguggcacacccugcagguagaggaggaaguugaugccaugcuggccgucaagaaguaaaggaaagaagaagccuuucugcauuugcccauauagugcucuuuagccaguaucuguaaauaccucaguaauauggguccuuucauuuuuccagccaugcauuccuaacacaauucagugguacuuggaauccuguuuuaauuugcacaaauuuaaauguagagagccccuaaguccuucaucauaccacugcccuccaaaucuacucuucuuuuaagcaauaugauguguagauagagcaugaaugaaauuauuuauuguaucacacuguuguauauaccaguaugcuaaagauuuauuucuaguuuguguauuuguauguuguaagcguuuccuaaucuguguauaucuagauguuuuuaauaagauguucuauuuuaaacuauguaaauugacugagauauaggagagcugauaauauauuauacgguaaauauaguaucgucugcauuccagcaaaaauaucaacucguaaggcacuaguacaguuaaacugacaucuuaaaggacaacuuaaaccugagcuuucuauugaaucauuugaguaccaagauaaacuuacaccacauacuuggugggugaauccaauuuuguagaauuccuacacaggcaaaauagcaugaucugagcagcagcauccaggcugaccucaaggaagcauagccacaaaacagaauagcaccugucuguacauauuuacaaagcuaaaauaauggcuucacucuuauauuugaggaagcaacugaacaggagucaaugauuucauauuacugcauauagaauaacaacaagguguuccgugugugugugugugugugugugugugugugugugcacauuuguuuggggaugggggagaagaagcuaaggggagaagucaacauuuaugaaauauugccugacuauuuaaaaagaaaaaaguagcucuccauuaucaccuuuauacaaaauguacauccugugaauucuguuccagauuucacaccuacaauaauuccaaaagguuugcacauuagaguuuguaacaaaauauuuuauuauauaaaaccagguuagaaggaaugcaggauauuuuuaacacaacaaucugugcuuauuacacaaaauuacuuugugguaaacagacaguauuguaaucccaucaaaagaugaaagaaaaacaaaaacaaaaaccaacaacaauuagccauaguucugaaugcacuucaauuaagccaaaacagacagcuagugaucuuuuuauaugcucuuuuuacuuaaguuuuaauuuguccuuuaaaaaaaggugaaacaaaccaagaacaaguucuagaaaacugaagcaaccucuuauguauacuagaugcuugauuuaggaggaguuuuuaaacguuuucaauguuauuauguaguaaaugacacuauuaugaagcuacuagucauuccauaagagucuuaaaggacugcucuguguaacacugugacugccgugugugcuuagacccguaguuuccucaguggauagcacucaauuuauuccguagugauauuguaacaauacugccauucccuucuacugcacugcccaagguguguguagcacaaacaguucucauuacaaaggaccaauucagaacugaaaagcuaugcauaggacaaggaagauacauagaaugggguggaacacagcauuuugucaagcacugugcaauauuccauauuuuuccccacuaugguagacaaccauuucguggaagggcagccuauuaucccacacugcaucuagccuuuugucccauucacuucugugauccauuuuaauuuccaggccacaagacaguagugaugcucugaaaugaaaguuugucuucacaaauaucaaaacaaaauggaggaaaacuaagcauuggccucauguucagucuucaggauaucacaccacgucuuuucaaaaacuaaagagaauucaaaaagggcugaugguaggcuuugaacaugggguuggcuguuucccaguaaaacuggaauuccugucguuacuguuuccuuaucaaagaaggggcaagcucuuuugccuuuuaggccagacauagcaaacgcuuuauaauuggcauagacauaaaggauaaaaggaaaauaaccgucugccgaugguccguacuucuuaaaaaacauagguaauagaaaauauacacaagucagaaugugaaauuaaauaaugguuugaacagaaaauucaaacaagacucuuuccaauuuaaagggccaaacccuaccaaagagagggaguugacuggcuuuuaaaaaguauuuaaauaccacaaaugacauuuaauuucacuguauucagcuuuaaguuguucacaaugaaaccacacuuucaaacaagcagguucaagcugcugaauagacauuauuucuugcauuaaaauaccacuaaugcauucucuugcaacacugccagacaugggauugucaccauagaauuaguugguacuaugccaucuuucacucuuucacaagucagugauggaaccugcuuuaugaccaagauucauccucaaauaagccacauguacccuucugacaaagcuguguaaaguauuagaaucugaugcucuagaaagauccuaguugccuuuguguauauuuacugccugcuugaguguuucuauguguggguuuucccuguaucuuguagaaauguugggguguuuuccucugccauauggcucguggccugcgagccaacuauuucagcuguauuuuaccuucauuuuugaugaggugauuuaaauuuuguuucacuuuguguagugaauuccacaguaguuuucugauuguuguuaaaaaugacuuaacauauuacacagauauucaauaaaaauguuuuauuuccuguugaaaaaaaaaaaaaaaaaa

SEQ ID NO: 66 - RNA, 938 nt, Homo_Sapiens
guugacuaagucaauaaucagaaucagcagguuugcagucagauuggcagggauaagcagccuagcucaggagaagugaguauaaaagccccaggcugggagcagccaucacagaaguccacucauucuuggcaggauggcuucucaucgucugcuccuccucugccuugcuggacugguauuugugucugaggcuggcccuacgggcaccggugaauccaaguguccucugauggucaaaguucuagaugcuguccgaggcaguccugccaucaauguggccgugcauguguucagaaaggcugcugaugacaccugggagccauuugccucugggaaaaccagugagucuggagagcugcaugggcucacaacugaggaggaauuuguagaagggauauacaaaguggaaauagacaccaaaucuuacuggaaggcacuuggcaucuccccauuccaugagcaugcagaggugguauucacagccaacgacuccggcccccgccgcuacaccauugccgcccugcugagccccuacuccuauuccaccacggcugucgucaccaaucccaaggaaugagggacuucuccuccaguggaccugaaggacgagggaugggauuucauguaaccaagaguauuccauuuuuacuaaagcaguguuuucaccucauaugcuauguuagaaguccaggcagagacaauaaaacauuccugugaaaggcacuuuucauuccacuuuaacuugauuuuuuaaauucccuuauugucccuuccaaaaaaaagagaaucaaaauuuuacaaagaaucaaaggaauucuagaaaguaucugggcagaacgcuaggagagauccaaauuuccauugucuugcaagcaaagcacguauuaaauaugaucugcagccauuaaaaagacacauucuguaaaaaaaaaaaa

SEQ ID NO: 67 - RNA, 5119 nt, Homo_Sapiens
acuuaagcuucgacgcaggaggcggggcugcucaguccuccaggcgucgguacucagcgguguuggaacuucguugcuugcuugccugugcgcgcgugcgcggacauggccucaaacgauuauacccaacaagcaacccaaagcuauggggccuaccccacccagcccgggcagggcuauucccagcagagcagucagcccuacggacagcagaguuacagugguuauagccaguccacggacacuucaggcuauggccagagcagcuauucuucuuauggccagagccagaacacaggcuauggaacucagucaacuccccagggauauggcucgacuggcggcuauggcaguagccagagcucccaaucgucuuacgggcagcaguccuccuacccuggcuauggccagcagccagcucccagcagcaccucgggaaguuacgguagcaguucucagagcagcagcuaugggcagccccagagugggagcuacagccagcagccuagcuaugguggacagcagcaaagcuauggacagcagcaaagcuauaaucccccucagggcuauggacagcagaaccaguacaacagcagcaguggugguggagguggagguggagguggagguaacuauggccaagaucaauccuccaugaguaguggugguggcagugguggcgguuauggcaaucaagaccagagugguggagguggcagcgguggcuauggacagcaggaccguggaggccgcggcagggguggcagugguggcggcggcggcggcggcgguggugguuacaaccgcagcagugguggcuaugaacccagaggucguggagguggccguggaggcagagguggcaugggcggaagugaccgugguggcuucaauaaauuugguggcccucgggaccaaggaucacgucaugacuccgaacaggauaauucagacaacaacaccaucuuugugcaaggccugggugagaauguuacaauugagucuguggcugauuacuucaagcagauugguauuauuaagacaaacaagaaaacgggacagcccaugauuaauuuguacacagacagggaaacuggcaagcugaagggagaggcaacggucucuuuugaugacccaccuucagcuaaagcagcuauugacugguuugaugguaaagaauucuccggaaauccuaucaaggucucauuugcuacucgccgggcagacuuuaaucggggugguggcaauggucguggaggccgagggcgaggaggacccaugggccguggaggcuauggaggugguggcagugguggugguggccgaggaggauuucccaguggaggugguggcgguggaggacagcagcgagcuggugacuggaaguguccuaaucccaccugugagaauaugaacuucucuuggaggaaugaaugcaaccaguguaaggccccuaaaccagauggcccaggagggggaccagguggcucucacaugggggguaacuacggggaugaucgucgugguggcagaggaggcuaugaucgaggcggcuaccggggccgcggcggggaccguggaggcuuccgagggggccggggugguggggacagagguggcuuuggcccuggcaagauggauuccaggggugagcacagacaggaucgcagggagaggccguauuaauuagccuggcuccccagguucuggaacagcuuuuuguccuguacccaguguuacccucguuauuuuguaaccuuccaauuccugaucacccaaggguuuuuuugugucggacuauguaauuguaacuauaccucugguucccauuaaaagugaccauuuuaguuaaauuuuguuccucuucccccuuuucacuuuccuggaagaucgaugucccgaucaggaagguagagaguuuuccuguucagauuacccugcccagcaggaacuggaauacaguguucggggagaaggccaaaugauauccuugagagcagagauuaaacuuuucugucauggggaaaguugguguauaaaugagaaaugaagaacaugggaugucaugaguguuggccuaaauuugcccagcuauggggaauuuuuccuuuaccacauuuauuugcauacuggucuuaguuuauuugcagcaguuuaucccuuuuuaagaacucuuugaucuuuuggcccuuuuaauggugaggcucaaacaaacuacauuuaaauggggcaguauucagauuugaccaugguggagagcgcuuagccacucugggucuuucacaggaaggagaguaacugagugcugcaggaguuuguggaguggagucaggaucuaggaggugagugacucccuuccuagcugcccuggugaacagcgcuuggguagauaccugcuauaaggagacuggucuggcuggguuacuuucacauccugccuguacucagagggcuugaggucauugacauuaugagauuuuaggcuugaucccuuuuugauuggaggguggaaggcccuccuaagggaaugauaagugauaagagggggaagggguugcagccaaugaguuaaaaccuuagagcagugcuccucagccucuuaccaugugguuguaaacuugcacguaccugccaaccaguuauuuagcaugcuuuuuauuuuaguuacacagagcguaacauuaacccaagagcagaaagguuuuauuuacaggguuuucgaacuugguuuguaagacagcugccaucacaagcauagcuuacaaaugugcuggggaccccuaauugggaagugcuuuccucucaaauuuuuauuuuuuauuuuuagagacagagucuugcucugucauccaggcuggagugcaguggcgugaucucggcucacuguagccucugccuccugaguuuaagcgauucuccugccucaggagaaucccagcuucugaguagcugagacuacaggcgugggccaccaugcccaccuaguuuuugcauuuuuaguggaggugugguuucacuguguuggccaggcuggucucuuaacuccugaccucaggugauccaccugccuuggccucccaaagugcuggaauuacaggcaugagccgcugcaucuggccauccucucaaauuuucaaguguuccacaaguauguucucuacugaagaguugcugcauccuugaaucuugggugauuugaggcacagaaacuaugacuuuauuuuuugagauggaguuuugcucuuguugcccaggcuggagugcaauggcacguuuuucggcuuaccgcaacugccgccuccuggguucaagcgauagcugggauuacaggcaugcgccaccaugcccagcuaauuuauuuguauuuuuaguagagacgggguuucuccauguuggucaggcuggucucgaacucccgaccucaggugaugugcacaccucagccucccaauaaaccaugacuuuuaagaggaauagcagguuuacuuccccugccagcauuggggugcucucuaagcaacaguaggcggagaguggucuggcguauuaaaaacaaaggaucgucaagugggccuucccaggcauugcuuugacuuaguacauguagaggauguggcaguucucuccgucccugccacugcugguuucuuuguuaaauguuuaguugaaauggccugauacgauauuugaguaguucacuguuggugcuuugccuagcaggauucuaaucuugcuuugguugugguccccugaugcccuccuguuaggaguggaggaggucgaagcuccuuguaagauaugauuacugggaccauuagugucaaguuccuguguccuucaaauggcauaugugauuggccuugaccuuaaaaggaaauagggucccaggugacuguuuaguggguagguccaguuuggggggaucuuccaggagaauggauagagacaccuagcagcagagagaacauuggugccucucaagccaaccucccaccucagccucccaaguagcugggacuacaggugcuuccucgcuaccacaccuggguaauuuuuuuuuuaauuacuuuuuuuuuuuuaagaaacaggguuucacuggguugcccaggcuggucuugaacuggccucaagugaccugccugccucagccucccaaagugcugggaucacaggugugacccacugcguuuggccagaauacucuauucuuacugaaugauugaaaucugucuugaagcauuaggugucccauuuuugugaguuggaauugggacaggcuaaguaggaagugaggaggguggggagagcugugcuguaggucuguuugucccuuccuugauguagccuucaguuagcccuuucagcuuuuuuccccaucuugugccgggccuuccuggguuucaguacuuggauguagggcugcaguuaugucagugguggguagauugaccaggaauuaaggucuaggguccagcccaugugagacuugacucacugaucuaccuuuaggcaugucuuccuuccagucucauccuuuuuaaauuuuuuuuuuuuuuuugagacggucucacucucacccaggcuggauugcaguggugugaucucgaccaacugcaaccucugccucccacccgcaagcuaucugcccaccucagccucuggaguagcugggacgggacuacaggcaccugccaccaugacuggcuaauuuuuuuuuguauuuuuuguggagauggggucuugccauguugcucaggcuggucuggucucaaaacugcucugggcucaagugauugucccacuuuggccucccagagugcugggauuaaggugugagauacuguguccggcuaugaaaauuuuauuuuuaauuaacuuguauauauuuaugggguacaauguccuauuucuguacauguacacauuguggaaucaaaucaggcuaauauauccaucacuucauaucauuagcaugaaugagaacauacaaagccacucuuagaaaauuuugaaauuuauguuauuucagcccuuuuaugcuggagguugcaaauguuuugugaauaaucagaccaaaaauaaaaacaaaaaaugauugacuucagucauucaguaagaa

SEQ ID NO: 68 - RNA, 5084 nt, Homo_Sapiens
acuuaagcuucgacgcaggaggcggggcugcucaguccuccaggcgucgguacucagcgguguuggaacuucguugcuugcuugccugugcgcgcgugcgcggacauggccucaaacgauuauacccaacaagcaacccaaagcuauggggccuaccccacccagcccgggcagggcuauucccagcagagcagucagcccuacggacagcagaguuacagugguuauagccaguccacggacacuucaggcuauggccagagcagcuauucuucuuauggccagagccagaacacaggcuauggaacucagucaacuccccagggauauggcucgacuggcggcuauggcaguagccagagcucccaaucgucuuacgggcagcaguccuccuacccuggcuauggccagcagccagcucccagcagcaccucgggaaguuacgguagcaguucucagagcagcagcuaugggcagccccagagugggagcuacagccagcagccuagcuaugguggacagcagcaaagcuauggacagcagcaaagcuauaaucccccucagggcuauggacagcagaaccaguacaacagcagcaguggugguggagguggagguggagguggagguaacuauggccaagaucaauccuccaugaguaguggugguggcagugguggcgguuauggcaaucaagaccagagugguggagguggcagcgguggcuauggacagcaggaccguggaggccgcggcagggguggcagugguggcggcggcggcggcggcgguggugguuacaaccgcagcagugguggcuaugaacccagaggucguggagguggccguggaggcagagguggcauggggcccucgggaccaaggaucacgucaugacuccgaacaggauaauucagacaacaacaccaucuuugugcaaggccugggugagaauguuacaauugagucuguggcugauuacuucaagcagauugguauuauuaagacaaacaagaaaacgggacagcccaugauuaauuuguacacagacagggaaacuggcaagcugaagggagaggcaacggucucuuuugaugacccaccuucagcuaaagcagcuauugacugguuugaugguaaagaauucuccggaaauccuaucaaggucucauuugcuacucgccgggcagacuuuaaucggggugguggcaauggucguggaggccgagggcgaggaggacccaugggccguggaggcuauggaggugguggcagugguggugguggccgaggaggauuucccaguggaggugguggcgguggaggacagcagcgagcuggugacuggaaguguccuaaucccaccugugagaauaugaacuucucuuggaggaaugaaugcaaccaguguaaggccccuaaaccagauggcccaggagggggaccagguggcucucacaugggggguaacuacggggaugaucgucgugguggcagaggaggcuaugaucgaggcggcuaccggggccgcggcggggaccguggaggcuuccgagggggccggggugguggggacagagguggcuuuggcccuggcaagauggauuccaggggugagcacagacaggaucgcagggagaggccguauuaauuagccuggcuccccagguucuggaacagcuuuuuguccuguacccaguguuacccucguuauuuuguaaccuuccaauuccugaucacccaaggguuuuuuugugucggacuauguaauuguaacuauaccucugguucccauuaaaagugaccauuuuaguuaaauuuuguuccucuucccccuuuucacuuuccuggaagaucgaugucccgaucaggaagguagagaguuuuccuguucagauuacccugcccagcaggaacuggaauacaguguucggggagaaggccaaaugauauccuugagagcagagauuaaacuuuucugucauggggaaaguugguguauaaaugagaaaugaagaacaugggaugucaugaguguuggccuaaauuugcccagcuauggggaauuuuuccuuuaccacauuuauuugcauacuggucuuaguuuauuugcagcaguuuaucccuuuuuaagaacucuuugaucuuuuggcccuuuuaauggugaggcucaaacaaacuacauuuaaauggggcaguauucagauuugaccaugguggagagcgcuuagccacucugggucuuucacaggaaggagaguaacugagugcugcaggaguuuguggaguggagucaggaucuaggaggugagugacucccuuccuagcugcccuggugaacagcgcuuggguagauaccugcuauaaggagacuggucuggcuggguuacuuucacauccugccuguacucagagggcuugaggucauugacauuaugagauuuuaggcuugaucccuuuuugauuggaggguggaaggcccuccuaagggaaugauaagugauaagagggggaagggguugcagccaaugaguuaaaaccuuagagcagugcuccucagccucuuaccaugugguuguaaacuugcacguaccugccaaccaguuauuuagcaugcuuuuuauuuuaguuacacagagcguaacauuaacccaagagcagaaagguuuuauuuacaggguuuucgaacuugguuuguaagacagcugccaucacaagcauagcuuacaaaugugcuggggaccccuaauugggaagugcuuuccucucaaauuuuuauuuuuuauuuuuagagacagagucuugcucugucauccaggcuggagugcaguggcgugaucucggcucacuguagccucugccuccugaguuuaagcgauucuccugccucaggagaaucccagcuucugaguagcugagacuacaggcgugggccaccaugcccaccuaguuuuugcauuuuuaguggaggugugguuucacuguguuggccaggcuggucucuuaacuccugaccucaggugauccaccugccuuggccucccaaagugcuggaauuacaggcaugagccgcugcaucuggccauccucucaaauuuucaaguguuccacaaguauguucucuacugaagaguugcugcauccuugaaucuugggugauuugaggcacagaaacuaugacuuuauuuuuugagauggaguuuugcucuuguugcccaggcuggagugcaauggcacguuuuucggcuuaccgcaacugccgccuccuggguucaagcgauagcugggauuacaggcaugcgccaccaugcccagcuaauuuauuuguauuuuuaguagagacgggguuucuccauguuggucaggcuggucucgaacucccgaccucaggugaugugcacaccucagccucccaauaaaccaugacuuuuaagaggaauagcagguuuacuuccccugccagcauuggggugcucucuaagcaacaguaggcggagaguggucuggcguauuaaaaacaaaggaucgucaagugggccuucccaggcauugcuuugacuuaguacauguagaggauguggcaguucucuccgucccugccacugcugguuucuuuguuaaauguuuaguugaaauggccugauacgauauuugaguaguucacuguuggugcuuugccuagcaggauucuaaucuugcuuugguugugguccccugaugcccuccuguuaggaguggaggaggucgaagcuccuuguaagauaugauuacugggaccauuagugucaaguuccuguguccuucaaauggcauaugugauuggccuugaccuuaaaaggaaauagggucccaggugacuguuuaguggguagguccaguuuggggggaucuuccaggagaauggauagagacaccuagcagcagagagaacauuggugccucucaagccaaccucccaccucagccucccaaguagcugggacuacaggugcuuccucgcuaccacaccuggguaauuuuuuuuuuaauuacuuuuuuuuuuuuaagaaacaggguuucacuggguugcccaggcuggucuugaacuggccucaagugaccugccugccucagccucccaaagugcugggaucacaggugugacccacugcguuuggccagaauacucuauucuuacugaaugauugaaaucugucuugaagcauuaggugucccauuuuugugaguuggaauugggacaggcuaaguaggaagugaggaggguggggagagcugugcuguaggucuguuugucccuuccuugauguagccuucaguuagcccuuucagcuuuuuuccccaucuugugccgggccuuccuggguuucaguacuuggauguagggcugcaguuaugucagugguggguagauugaccaggaauuaaggucuaggguccagcccaugugagacuugacucacugaucuaccuuuaggcaugucuuccuuccagucucauccuuuuuaaauuuuuuuuuuuuuuuugagacggucucacucucacccaggcuggauugcaguggugugaucucgaccaacugcaaccucugccucccacccgcaagcuaucugcccaccucagccucuggaguagcugggacgggacuacaggcaccugccaccaugacuggcuaauuuuuuuuuguauuuuuuguggagauggggucuugccauguugcucaggcuggucuggucucaaaacugcucugggcucaagugauugucccacuuuggccucccagagugcugggauuaaggugugagauacuguguccggcuaugaaaauuuuauuuuuaauuaacuuguauauauuuaugggguacaauguccuauuucuguacauguacacauuguggaaucaaaucaggcuaauauauccaucacuucauaucauuagcaugaaugagaacauacaaagccacucuuagaaaauuuugaaauuuauguuauuucagcccuuuuaugcuggagguugcaaauguuuugugaauaaucagaccaaaaauaaaaacaaaaaaugauugacuucagucauucaguaagaa

SEQ ID NO: 69 - RNA, 5116 nt, Homo_Sapiens
acuuaagcuucgacgcaggaggcggggcugcucaguccuccaggcgucgguacucagcgguguuggaacuucguugcuugcuugccugugcgcgcgugcgcggacauggccucaaacgauuauacccaacaagcaacccaaagcuauggggccuaccccacccagcccgggcagggcuauucccagcagagcagucagcccuacggacagcagaguuacagugguuauagccaguccacggacacuucaggcuauggccagagcagcuauucuucuuauggccagagccagaacagcuauggaacucagucaacuccccagggauauggcucgacuggcggcuauggcaguagccagagcucccaaucgucuuacgggcagcaguccuccuacccuggcuauggccagcagccagcucccagcagcaccucgggaaguuacgguagcaguucucagagcagcagcuaugggcagccccagagugggagcuacagccagcagccuagcuaugguggacagcagcaaagcuauggacagcagcaaagcuauaaucccccucagggcuauggacagcagaaccaguacaacagcagcaguggugguggagguggagguggagguggagguaacuauggccaagaucaauccuccaugaguaguggugguggcagugguggcgguuauggcaaucaagaccagagugguggagguggcagcgguggcuauggacagcaggaccguggaggccgcggcagggguggcagugguggcggcggcggcggcggcgguggugguuacaaccgcagcagugguggcuaugaacccagaggucguggagguggccguggaggcagagguggcaugggcggaagugaccgugguggcuucaauaaauuugguggcccucgggaccaaggaucacgucaugacuccgaacaggauaauucagacaacaacaccaucuuugugcaaggccugggugagaauguuacaauugagucuguggcugauuacuucaagcagauugguauuauuaagacaaacaagaaaacgggacagcccaugauuaauuuguacacagacagggaaacuggcaagcugaagggagaggcaacggucucuuuugaugacccaccuucagcuaaagcagcuauugacugguuugaugguaaagaauucuccggaaauccuaucaaggucucauuugcuacucgccgggcagacuuuaaucggggugguggcaauggucguggaggccgagggcgaggaggacccaugggccguggaggcuauggaggugguggcagugguggugguggccgaggaggauuucccaguggaggugguggcgguggaggacagcagcgagcuggugacuggaaguguccuaaucccaccugugagaauaugaacuucucuuggaggaaugaaugcaaccaguguaaggccccuaaaccagauggcccaggagggggaccagguggcucucacaugggggguaacuacggggaugaucgucgugguggcagaggaggcuaugaucgaggcggcuaccggggccgcggcggggaccguggaggcuuccgagggggccggggugguggggacagagguggcuuuggcccuggcaagauggauuccaggggugagcacagacaggaucgcagggagaggccguauuaauuagccuggcuccccagguucuggaacagcuuuuuguccuguacccaguguuacccucguuauuuuguaaccuuccaauuccugaucacccaaggguuuuuuugugucggacuauguaauuguaacuauaccucugguucccauuaaaagugaccauuuuaguuaaauuuuguuccucuucccccuuuucacuuuccuggaagaucgaugucccgaucaggaagguagagaguuuuccuguucagauuacccugcccagcaggaacuggaauacaguguucggggagaaggccaaaugauauccuugagagcagagauuaaacuuuucugucauggggaaaguugguguauaaaugagaaaugaagaacaugggaugucaugaguguuggccuaaauuugcccagcuauggggaauuuuuccuuuaccacauuuauuugcauacuggucuuaguuuauuugcagcaguuuaucccuuuuuaagaacucuuugaucuuuuggcccuuuuaauggugaggcucaaacaaacuacauuuaaauggggcaguauucagauuugaccaugguggagagcgcuuagccacucugggucuuucacaggaaggagaguaacugagugcugcaggaguuuguggaguggagucaggaucuaggaggugagugacucccuuccuagcugcccuggugaacagcgcuuggguagauaccugcuauaaggagacuggucuggcuggguuacuuucacauccugccuguacucagagggcuugaggucauugacauuaugagauuuuaggcuugaucccuuuuugauuggaggguggaaggcccuccuaagggaaugauaagugauaagagggggaagggguugcagccaaugaguuaaaaccuuagagcagugcuccucagccucuuaccaugugguuguaaacuugcacguaccugccaaccaguuauuuagcaugcuuuuuauuuuaguuacacagagcguaacauuaacccaagagcagaaagguuuuauuuacaggguuuucgaacuugguuuguaagacagcugccaucacaagcauagcuuacaaaugugcuggggaccccuaauugggaagugcuuuccucucaaauuuuuauuuuuuauuuuuagagacagagucuugcucugucauccaggcuggagugcaguggcgugaucucggcucacuguagccucugccuccugaguuuaagcgauucuccugccucaggagaaucccagcuucugaguagcugagacuacaggcgugggccaccaugcccaccuaguuuuugcauuuuuaguggaggugugguuucacuguguuggccaggcuggucucuuaacuccugaccucaggugauccaccugccuuggccucccaaagugcuggaauuacaggcaugagccgcugcaucuggccauccucucaaauuuucaaguguuccacaaguauguucucuacugaagaguugcugcauccuugaaucuugggugauuugaggcacagaaacuaugacuuuauuuuuugagauggaguuuugcucuuguugcccaggcuggagugcaauggcacguuuuucggcuuaccgcaacugccgccuccuggguucaagcgauagcugggauuacaggcaugcgccaccaugcccagcuaauuuauuuguauuuuuaguagagacgggguuucuccauguuggucaggcuggucucgaacucccgaccucaggugaugugcacaccucagccucccaauaaaccaugacuuuuaagaggaauagcagguuuacuuccccugccagcauuggggugcucucuaagcaacaguaggcggagaguggucuggcguauuaaaaacaaaggaucgucaagugggccuucccaggcauugcuuugacuuaguacauguagaggauguggcaguucucuccgucccugccacugcugguuucuuuguuaaauguuuaguugaaauggccugauacgauauuugaguaguucacuguuggugcuuugccuagcaggauucuaaucuugcuuugguugugguccccugaugcccuccuguuaggaguggaggaggucgaagcuccuuguaagauaugauuacugggaccauuagugucaaguuccuguguccuucaaauggcauaugugauuggccuugaccuuaaaaggaaauagggucccaggugacuguuuaguggguagguccaguuuggggggaucuuccaggagaauggauagagacaccuagcagcagagagaacauuggugccucucaagccaaccucccaccucagccucccaaguagcugggacuacaggugcuuccucgcuaccacaccuggguaauuuuuuuuuuaauuacuuuuuuuuuuuuaagaaacaggguuucacuggguugcccaggcuggucuugaacuggccucaagugaccugccugccucagccucccaaagugcugggaucacaggugugacccacugcguuuggccagaauacucuauucuuacugaaugauugaaaucugucuugaagcauuaggugucccauuuuugugaguuggaauugggacaggcuaaguaggaagugaggaggguggggagagcugugcuguaggucuguuugucccuuccuugauguagccuucaguuagcccuuucagcuuuuuuccccaucuugugccgggccuuccuggguuucaguacuuggauguagggcugcaguuaugucagugguggguagauugaccaggaauuaaggucuaggguccagcccaugugagacuugacucacugaucuaccuuuaggcaugucuuccuuccagucucauccuuuuuaaauuuuuuuuuuuuuuuugagacggucucacucucacccaggcuggauugcaguggugugaucucgaccaacugcaaccucugccucccacccgcaagcuaucugcccaccucagccucuggaguagcugggacgggacuacaggcaccugccaccaugacuggcuaauuuuuuuuuguauuuuuuguggagauggggucuugccauguugcucaggcuggucuggucucaaaacugcucugggcucaagugauugucccacuuuggccucccagagugcugggauuaaggugugagauacuguguccggcuaugaaaauuuuauuuuuaauuaacuuguauauauuuaugggguacaauguccuauuucuguacauguacacauuguggaaucaaaucaggcuaauauauccaucacuucauaucauuagcaugaaugagaacauacaaagccacucuuagaaaauuuugaaauuuauguuauuucagcccuuuuaugcuggagguugcaaauguuuugugaauaaucagaccaaaaauaaaaacaaaaaaugauugacuucagucauucaguaagaa

SEQ ID NO: 70 - RNA, 5107 nt, Homo_Sapiens
acuuaagcuucgacgcaggaggcggggcugcucaguccuccaggcgucgguacucagcgguguuggaacuucguugcuugcuugccugugcgcgcgugcgcggacauggccucaaacgauuauacccaacaagcaacccaaagcuauggggccuaccccacccagcccgggcagggcuauucccagcagagcagucagcccuacggacagcagaguuacagugguuauagccaguccacggacacuucaggcuauggccagagcagcuauucuucuuauggccagagccagaacacaggcuauggaacucagucaacuccccagggauauggcucgacuggcggcuauggcaguagccagagcucccaaucgucuuacgggcagcaguccuccuacccuggcuauggccagcagccagcucccagcagcaccucgggaaguuacgguagcaguucucagagcagcagcuaugggcagccccagagugggagcuacagccagcagccuagcuaugguggacagcagcaaagcuauggacagcagcaaagcuauaaucccccucagggcuauggacagcagaaccaguacaacagcagcaguggugguggagguggagguaacuauggccaagaucaauccuccaugaguaguggugguggcagugguggcgguuauggcaaucaagaccagagugguggagguggcagcgguggcuauggacagcaggaccguggaggccgcggcagggguggcagugguggcggcggcggcggcggcgguggugguuacaaccgcagcagugguggcuaugaacccagaggucguggagguggccguggaggcagagguggcaugggcggaagugaccgugguggcuucaauaaauuugguggcccucgggaccaaggaucacgucaugacuccgaacaggauaauucagacaacaacaccaucuuugugcaaggccugggugagaauguuacaauugagucuguggcugauuacuucaagcagauugguauuauuaagacaaacaagaaaacgggacagcccaugauuaauuuguacacagacagggaaacuggcaagcugaagggagaggcaacggucucuuuugaugacccaccuucagcuaaagcagcuauugacugguuugaugguaaagaauucuccggaaauccuaucaaggucucauuugcuacucgccgggcagacuuuaaucggggugguggcaauggucguggaggccgagggcgaggaggacccaugggccguggaggcuauggaggugguggcagugguggugguggccgaggaggauuucccaguggaggugguggcgguggaggacagcagcgagcuggugacuggaaguguccuaaucccaccugugagaauaugaacuucucuuggaggaaugaaugcaaccaguguaaggccccuaaaccagauggcccaggagggggaccagguggcucucacaugggggguaacuacggggaugaucgucgugguggcagaggaggcuaugaucgaggcggcuaccggggccgcggcggggaccguggaggcuuccgagggggccggggugguggggacagagguggcuuuggcccuggcaagauggauuccaggggugagcacagacaggaucgcagggagaggccguauuaauuagccuggcuccccagguucuggaacagcuuuuuguccuguacccaguguuacccucguuauuuuguaaccuuccaauuccugaucacccaaggguuuuuuugugucggacuauguaauuguaacuauaccucugguucccauuaaaagugaccauuuuaguuaaauuuuguuccucuucccccuuuucacuuuccuggaagaucgaugucccgaucaggaagguagagaguuuuccuguucagauuacccugcccagcaggaacuggaauacaguguucggggagaaggccaaaugauauccuugagagcagagauuaaacuuuucugucauggggaaaguugguguauaaaugagaaaugaagaacaugggaugucaugaguguuggccuaaauuugcccagcuauggggaauuuuuccuuuaccacauuuauuugcauacuggucuuaguuuauuugcagcaguuuaucccuuuuuaagaacucuuugaucuuuuggcccuuuuaauggugaggcucaaacaaacuacauuuaaauggggcaguauucagauuugaccaugguggagagcgcuuagccacucugggucuuucacaggaaggagaguaacugagugcugcaggaguuuguggaguggagucaggaucuaggaggugagugacucccuuccuagcugcccuggugaacagcgcuuggguagauaccugcuauaaggagacuggucuggcuggguuacuuucacauccugccuguacucagagggcuugaggucauugacauuaugagauuuuaggcuugaucccuuuuugauuggaggguggaaggcccuccuaagggaaugauaagugauaagagggggaagggguugcagccaaugaguuaaaaccuuagagcagugcuccucagccucuuaccaugugguuguaaacuugcacguaccugccaaccaguuauuuagcaugcuuuuuauuuuaguuacacagagcguaacauuaacccaagagcagaaagguuuuauuuacaggguuuucgaacuugguuuguaagacagcugccaucacaagcauagcuuacaaaugugcuggggaccccuaauugggaagugcuuuccucucaaauuuuuauuuuuuauuuuuagagacagagucuugcucugucauccaggcuggagugcaguggcgugaucucggcucacuguagccucugccuccugaguuuaagcgauucuccugccucaggagaaucccagcuucugaguagcugagacuacaggcgugggccaccaugcccaccuaguuuuugcauuuuuaguggaggugugguuucacuguguuggccaggcuggucucuuaacuccugaccucaggugauccaccugccuuggccucccaaagugcuggaauuacaggcaugagccgcugcaucuggccauccucucaaauuuucaaguguuccacaaguauguucucuacugaagaguugcugcauccuugaaucuugggugauuugaggcacagaaacuaugacuuuauuuuuugagauggaguuuugcucuuguugcccaggcuggagugcaauggcacguuuuucggcuuaccgcaacugccgccuccuggguucaagcgauagcugggauuacaggcaugcgccaccaugcccagcuaauuuauuuguauuuuuaguagagacgggguuucuccauguuggucaggcuggucucgaacucccgaccucaggugaugugcacaccucagccucccaauaaaccaugacuuuuaagaggaauagcagguuuacuuccccugccagcauuggggugcucucuaagcaacaguaggcggagaguggucuggcguauuaaaaacaaaggaucgucaagugggccuucccaggcauugcuuugacuuaguacauguagaggauguggcaguucucuccgucccugccacugcugguuucuuuguuaaauguuuaguugaaauggccugauacgauauuugaguaguucacuguuggugcuuugccuagcaggauucuaaucuugcuuugguugugguccccugaugcccuccuguuaggaguggaggaggucgaagcuccuuguaagauaugauuacugggaccauuagugucaaguuccuguguccuucaaauggcauaugugauuggccuugaccuuaaaaggaaauagggucccaggugacuguuuaguggguagguccaguuuggggggaucuuccaggagaauggauagagacaccuagcagcagagagaacauuggugccucucaagccaaccucccaccucagccucccaaguagcugggacuacaggugcuuccucgcuaccacaccuggguaauuuuuuuuuuaauuacuuuuuuuuuuuuaagaaacaggguuucacuggguugcccaggcuggucuugaacuggccucaagugaccugccugccucagccucccaaagugcugggaucacaggugugacccacugcguuuggccagaauacucuauucuuacugaaugauugaaaucugucuugaagcauuaggugucccauuuuugugaguuggaauugggacaggcuaaguaggaagugaggaggguggggagagcugugcuguaggucuguuugucccuuccuugauguagccuucaguuagcccuuucagcuuuuuuccccaucuugugccgggccuuccuggguuucaguacuuggauguagggcugcaguuaugucagugguggguagauugaccaggaauuaaggucuaggguccagcccaugugagacuugacucacugaucuaccuuuaggcaugucuuccuuccagucucauccuuuuuaaauuuuuuuuuuuuuuuugagacggucucacucucacccaggcuggauugcaguggugugaucucgaccaacugcaaccucugccucccacccgcaagcuaucugcccaccucagccucuggaguagcugggacgggacuacaggcaccugccaccaugacuggcuaauuuuuuuuuguauuuuuuguggagauggggucuugccauguugcucaggcuggucuggucucaaaacugcucugggcucaagugauugucccacuuuggccucccagagugcugggauuaaggugugagauacuguguccggcuaugaaaauuuuauuuuuaauuaacuuguauauauuuaugggguacaauguccuauuucuguacauguacacauuguggaaucaaaucaggcuaauauauccaucacuucauaucauuagcaugaaugagaacauacaaagccacucuuagaaaauuuugaaauuuauguuauuucagcccuuuuaugcuggagguugcaaauguuuugugaauaaucagaccaaaaauaaaaacaaaaaaugauugacuucagucauucaguaagaa

SEQ ID NO: 71 - RNA, 3025 nt, Homo_Sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaaaaaaaa

SEQ ID NO: 72 - RNA, 3046 nt, Homo_Sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaagggucgaucugggaccucggacccuggcucugagggccacauccgccuccccccuucccaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 73 - RNA, 2902 nt, Homo_Sapiens
gcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 74 - RNA, 743 nt, Homo_Sapiens
cgcgccuagcagugucccagccggguucgugucgccauggggcagaucgagugggccaugugggccaacgaacaggcgcuggcguccggccugauccucaucaccgggggcaucguggccacagcugggcgcuucacccagugguacuuuggugccuacuccauuguggcgggcguguuugugugccugcuggaguacccccgggggaagaggaagaagggcuccaccauggagcgcuggggacagaaguacaugaccgccguggugaagcuguucgggcccuuuaccaggaauuacuauguucgggccguccugcaucuccugcucucggugcccgccggcuuccugcuggccaccauccuugggaccgccugccuggccauugcgagcggcaucuaccuacuggcggcugugcguggcgagcaguggacgcccaucgagcccaagccccgggagcggccgcagaucggaggcaccaucaagcagccgcccagcaaccccccgccgcggcccccggccgaggcccgcaagaagcccagcgaggaggaggcugcgguggcggcggggggacccccgggagguccccaggucaaccccaucccggugaccgacgaggucgugugaccucgccccggaccugcccucccgccaggugcacccaccugcaauaaaugcagcgaagccgggaaaaaaaaaaaaaaaaaaaaaaaaaaaaaaaaaaaaaaaaaaaaaaaaaaaaaaaa

SEQ ID NO: 75 - RNA, 2049 nt, Homo_Sapiens
cgggaagcuauuaauagcauuacgucagccugggacuggcaacacggaguaaacgaccgcgccgccagccugagggcuauaaaaggggugaugcaacgcucuccaagccacagucgcacgcagccaggcgcgcacugcacagcucucuucucucgccgccgcccgagcgcacccuucagcccgcgcgccggccgugaguccucggugcucgcccgccggccagacaaacagcccgcccgaccccgucccgacccuggccgccccgagcggagccuggagcaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguagccccugaagaagaugaaaggaaaaagaggcgacgagaaagaaauaagauugcagcugcaaagugccgaaacaagaagaaggagaagacggagugccugcagaaagagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaa

SEQ ID NO: 76 - RNA, 1914 nt, Homo_Sapiens
aguugaccaaccaugccuugaggauaaauuggaugggaucagaugggaagaugugacaagaagagaaauccuccucuauauaggaugcucugcuguuuccuaaggauuuucagcaccuugccccaaaaucaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguagccccugaagaagaugaaaggaaaaagaggcgacgagaaagaaauaagauugcagcugcaaagugccgaaacaagaagaaggagaagacggagugccugcagaaagagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaaaaaaaaaaaaaaaaa

SEQ ID NO: 77 - RNA, 2361 nt, Homo_Sapiens
cgggaagcuauuaauagcauuacgucagccugggacuggcaacacggaguaaacgaccgcgccgccagccugagggcuauaaaaggggugaugcaacgcucuccaagccacagucgcacgcagccaggcgcgcacugcacagcucucuucucucgccgccgcccgagcgcacccuucagcccgcgcgccggccgugaguccucggugcucgcccgccggccagacaaacagcccgcccgaccccgucccgacccuggccgccccgagcggagccuggagcaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguagccccugaagaagaugaaaggaaaaagaggcgacgagaaagaaauaagauugcagcugcaaagugccgaaacaagaagaaggagaagacggagugccugcagaaacucccaaggcccuuuuggguccagaagaccugcauaugggcuguugacucaugcaaaugagguaucugaacugcagcuucaguauuagcagagccacaggccgccucuguggcaucaccaggguuucucugaagaagagggucugcauuuuccuaaacccagugcugcucucccaucucccaucuuccucucgcagcuugaugagccccggugugucccagguacaccccugcauccaggcagcagcccaggccacccccuccucacuggcccuuggcuccuuucuugaugccucuguugcuugucccccaggagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaa

SEQ ID NO: 78 - RNA, 716 nt, Homo_Sapiens
gaaacuugguguccaggggaggcccccggcggcuggagcgcggcggcagcgggcgcagaggccggagggagaggaggcgaggggcggcccgagcgcggggcgggagcgaggccagcggucaugugcccgugcccccugcaccgcggccgcggccccccggccgugugcgccugcagcgcgggucgccuggggcugcgcucguccgccgcgcagcucaccgccgcccggcucaaggcgcuaggcgacgagcugcaccagcgcaccauguggcggcgccgcgcgcggagccggagggcgccggcgcccggcgcgcuccccaccuacuggccuuggcugugcgcggccgcgcagguggcggcgcuggcggccuggcugcucggcaggcggaacuuguaggaacgcggggcuucuugguggggccggagccgagacccagccggagcgagcaacagguuggugaaaacccuguguccuuggagaaagcugguucccguuuuccagagggggagcccagagcuugaaaggccgcgguuggcacuucgagaaggaaguggagaguaaagacagcgccuggagcgaucguagaaacacagaaugggacuggggaagcccuuuggaaauccagcugcagaaacagacaccccaaugcuauuuacauacagcucuauauauauaaaaaaagaaaauaugaauauuaaaaaaaaaaaaaaaaaaaa

SEQ ID NO: 79 - RNA, 1163 nt, Homo_Sapiens
ccggcggcgccucaggucgcggggcgccuaggccuggguuguccuuugcaucugcacguguucgcagucguuuccgcgaugcugccucugcugcgcugcgugccccgugugcugggcuccuccgucgccggccuccgcgcugccgcgcccgccucgccuuuccggcagcuccugcagccggcaccccggcugugcacccggcccuucgggcugcucagcgugcgcgcagguuccgagcggcggccgggccuccugcggccucgcggacccugcgccuguggcuguggcugcggcucgcugcacaccgacggagacaaagcuuuuguugauuuccugagugaugaaauuaaggaggaaagaaaaauucagaagcauaaaacccucccuaagaugucuggagguugggagcuggaacugaaugggacagaagcgaaauuagugcggaaaguugccggggaaaaaaucacggucacuuucaacauuaacaacagcaucccaccaacauuugauggugaggaggaacccucgcaagggcagaagguugaagaacaggagccugaacugacaucaacucccaauuucgugguugaaguuauaaagaaugaugauggcaagaaggcccuuguguuggacugucauuauccagaggaugagguuggacaagaagacgaggcugagagugacaucuucucuaucagggaaguuagcuuucaguccacuggcgagucugaauggaaggauacuaauuauacacucaacacagauuccuuggacugggccuuauaugaccaccuaauggauuuccuugccgaccgagggguggacaacacuuuugcagaugagcugguggagcucagcacagcccuggagcaccaggaguacauuacuuuucuugaagaccucaagaguuuugucaagagccaguagagcagacagaugcugaaagccauaguuucauggcaggcuuuggccagugaacaaauccuacucugaagcuagacaugugcuuugaaaugauuaucauccuaauaucaugggggaaaaaauaccaaauuuaaauuauauguuuuguguucucauuuauuaucauuuuuuucuguacaaaucuauuauuucuagauuuuuguauaacaugauagacauaaaauugguuuaucuccucc

SEQ ID NO: 80 - RNA, 1535 nt, Homo_Sapiens
ccuccgcucaguccgggagcgcacgugggccgcggcgcuccgaccuccgcuuucccaccgcccgcagcugaagcacaucccgcagcccggcgcggacuccgaucgccgcaguugcccucuggcgccaugucgcagaacggagcgcccgggaugcaggaggagagccugcagggcuccuggguagaacugcacuucagcaauaaugggaacgggggcagcguuccagccucgguuucuauuuauaauggagacauggaaaaaauacugcuggacgcacagcaugagucuggacggaguagcuccaagagcucucacugugacagcccaccucgcucgcagacaccacaagauaccaacagggcuucugaaacagauacccauagcauuggagagaaaaacagcucacagucugaggaagaugauauugaaagaaggaaagaaguugaaagcaucuugaagaaaaacucagauuggauaugggauuggucaagucggccggaaaauauuccccccaaggaguuccucuuuaaacacccgaagcgcacggccacccucagcaugaggaacacgagcgucaugaagaaagggggcauauucucugcagaauuucugaaaguuuuccuuccaucucugcugcucucucauuugcuggccaucggauuggggaucuauauuggaaggcgucugacaaccuccaccagcaccuuuugaugaagaacuggagucugacuugguucguuaguggauuacuucugagcuugcaacauagcucacugaagagcuguuagauccugggguggccacgucacuuguguuuauuuguucuguaaaugcugcguuccuaauuuaguaaaauaaaagaauagacacuaaaaucauguugaucuauaauuacaccuaugggaucaauaagcaugucagacugauuaaugucuacugugaaaauuugguaguaaauuuucauuugauauuagauauaaauaucugaauauaaauaauuuuaauauacuagucaugauguguguuguauuuuaaaaauuaucugcaaccuuaauucagcugaaguacuuuauauuucaaaagaaugaauaacauugauaauaaaaucgcuacuuuaagggguuuguccaaaauaaauauuguggccuuauauaucacacuauuguagaaaguauuauuuaauuuaaauggaugcagguugucuacuaaagaaagauuauauauaacuaugcuaauuguucauaaucaacagaaaccaagauagagcuacaaacucagcuguacaguucguacacuaaacucuucuugcuuuugcauuauaaggaauuaagucuccgauuauuaggugaucacccuggaugaucaguuuucugcugaaggcaccuacucaguaucuuuuccucuuuaucacucugcauuggugaauuuaauccucuccuuuguguucaacuuuugugugcuuuuaaaaucagcuuuauucuaagcaaaucugugucuacuuuaaaaaacuggaaauggaaaaaaaaauaaaucuu

SEQ ID NO: 81 - RNA, 1412 nt, Homo_Sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguggauuuauggucuguggggugcauuaugggagaaaugguuugccacaaaauccucuuuccaggaagggacuauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 82 - RNA, 1417 nt, Homo_Sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguggauuuauggucuguggggugcauuaugggagaaaugguuugccacaaaauccucuuuccaggaagggacuauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuagcacaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 83 - RNA, 1417 nt, Homo_Sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguugacauuuggucaguugggugcaucaugggagaaaugaucaaaggugguguuuuguucccagguacagaucauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuagcacaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 84 - RNA, 1412 nt, Homo_Sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguugacauuuggucaguugggugcaucaugggagaaaugaucaaaggugguguuuuguucccagguacagaucauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 85 - RNA, 4353 nt, Homo_Sapiens
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauuaaccagcuucagcagauuaugcgucugacaggaacaccccccgcuuaucucauuaacaggaugccaagccaugaggcaagaaacuauauucagucuuugacucagaugccgaagaugaacuuugcgaauguauuuauuggugccaauccccuggcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuuagugaguuucucaaguuuauuauauuuuucucuuguuuuuauuuaaugcacaauauggcauuauaucaauauccuuuaaacugugaccuggcauacuugucugacagaucuuaauacuacuccuaacauuuagaaaauguugauaaagcuucuuaguuguacauuuuuuggugaagaguauccaggucuuugcuguggauggguaaagcaaagagcaaaugaacgaaguauuaagcauuggggccugucuuaucuacacucgaguguaagaguggccgaaaugacagggcucagcagacuguggccugagggccaaaucuggcccaccaccuguuugguguagccugcuaagaauggcuuuuacauuuuuaaaugguugggaaagaaaaaaaaagaaguaguagauuuuguagcaugugauguaaguaauguaaaacuuaaauuccaguauccauaaauaaaguuuuaugagaacaga

SEQ ID NO: 86 - RNA, 4353 nt, Homo_Sapiens
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucugcaagaaacuauauucagucuuugacucagaugccgaagaugaacuuugcgaauguauuuauuggugccaauccccuggcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuuagugaguuucucaaguuuauuauauuuuucucuuguuuuuauuuaaugcacaauauggcauuauaucaauauccuuuaaacugugaccuggcauacuugucugacagaucuuaauacuacuccuaacauuuagaaaauguugauaaagcuucuuaguuguacauuuuuuggugaagaguauccaggucuuugcuguggauggguaaagcaaagagcaaaugaacgaaguauuaagcauuggggccugucuuaucuacacucgaguguaagaguggccgaaaugacagggcucagcagacuguggccugagggccaaaucuggcccaccaccuguuugguguagccugcuaagaauggcuuuuacauuuuuaaaugguugggaaagaaaaaaaaagaaguaguagauuuuguagcaugugauguaaguaauguaaaacuuaaauuccaguauccauaaauaaaguuuuaugagaacaga

SEQ ID NO: 87 - RNA, 1431 nt, Homo_Sapiens
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucugcaagaaacuauauucagucuuugacucagaugccgaagaugaacuuugcgaauguauuuauuggugccaauccccuggguaaguugaccauauauccucaccucauggauauugaauugguuaugauauaaauuggggauuugaagaagaguuucuccuuuugaccaaauaaaguaccauuaguuga

SEQ ID NO: 88 - RNA, 4274 nt, Homo_Sapiens
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucucugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuuagugaguuucucaaguuuauuauauuuuucucuuguuuuuauuuaaugcacaauauggcauuauaucaauauccuuuaaacugugaccuggcauacuugucugacagaucuuaauacuacuccuaacauuuagaaaauguugauaaagcuucuuaguuguacauuuuuuggugaagaguauccaggucuuugcuguggauggguaaagcaaagagcaaaugaacgaaguauuaagcauuggggccugucuuaucuacacucgaguguaagaguggccgaaaugacagggcucagcagacuguggccugagggccaaaucuggcccaccaccuguuugguguagccugcuaagaauggcuuuuacauuuuuaaaugguugggaaagaaaaaaaaagaaguaguagauuuuguagcaugugauguaaguaauguaaaacuuaaauuccaguauccauaaauaaaguuuuaugagaacaga

SEQ ID NO: 89 - RNA, 2341 nt, Homo_Sapiens
gggaggccggaugugaguggagcggccauuuccuguuucucugcaguuuuccucagcuuugggugguggccgcugccgggcaucggcuuccaguccgcggagggcgaggcggcguggacagcggccccggcacccagcgccccgccgcccgcaagccgcgcgcccguccgccgcgccccgagcccgccgcuuccuaucucagcgcccugccgccgccgccgcggcccagcgagcggcccugaugcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaaaugucucagccccucguucuugguccugucccuuggaaccuuuguacgcuuugcucaaaaaaaaacaaaaaaaaaaaacaaaaaaaaaaaacaacgguggagccuucgcacucaaugccaacuuuuuguuacagauuaauuuuuccauaaaaccauuuuuugaaccaaucaguaauuuuaagguuuuguuuguucuaaauguaagaguucagacucacauucuauuaaaauuuagcccuaaaaugacaagccuucuuaaagccuuauuuuucaaaagcgccccccccauucuuguucagauuaagaguugccaaaauaccuucugaacuacacugcauuguugugccgagaacaccgagcacugaacuuugcaaagaccuucgucuuugagaagacgguagcuucugcaguuaggaggugcagacacuugcucuccuauguaguucucagaugcguaaagcagaacagccucccgaaugaagcguugccauugaacucaccagugaguuagcagcacguguucccgacauaacauuguacuguaauggagugagcguagcagcucagcucuuuggaucagucuuugugauuucauagcgaguuuucugaccagcuuuugcggagauuuugaacagaacugcuauuuccucuaaugaagaauucuguuuagcugugggugugccggguggggugugugugaucaaaggacaaagacaguauuuugacaaaauacgaaguggagauuuacacuacauuguacaaggaaugaaagugucacggguaaaaacucuaaaagguuaauuucugucaaaugcaguagaugaugaaagaaagguugguauuaucaggaaauguuuucuuaagcuuuuccuuucucuuacaccugccaugccuccccaaauugggcauuuaauucaucuuuaaacugguuguucuguuagucgcuaacuuaguaagugcuuuucuuauagaaccccuucugacugagcaauaugccuccuuguauuauaaaaucuuucugauaaugcauuagaagguuuuuuugucgauuaguaaaagugcuuuccauguuacuuuauucagagcuaauaagugcuuuccuuaguuuucuaguaacuagguguaaaaaucauguguugcagcuuuauaguuuuuaaaauauuuuagauaauucuuaaacuaugaaccuucuuaacaucacugucuugccagauuaccgacacugucacuugaccaauacugacccucuuuaccucgcccacgcggacacacgccuccuguagucgcuuugccuauugauguuccuuugggucugugagguucuguaaacugugcuagugcugacgauguucuguacaacuuaacucacuggcgagaauacagcgugggacccuucagccacuacaacagaauuuuuuaaauugacaguugcagaauuguggaguguuuuuacauugaucuuuugcuaaugcaauuagcauuauguuuugcauguaugacuuaauaaauccuugaaucaua

SEQ ID NO: 90 - RNA, 2398 nt, Homo_Sapiens
gggaggccggaugugaguggagcggccauuuccuguuucucugcaguuuuccucagcuuugggugguggccgcugccgggcaucggcuuccaguccgcggagggcgaggcggcguggacagcggccccggcacccagcgccccgccgcccgcaagccgcgcgcccguccgccgcgccccgagcccgccgcuuccuaucucagcgcccugccgccgccgccgcggcccagcgagcggcccugaugcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacaguuggagaaacguacgguaaggauauaaccucccggggcaaagacaagccgauugccgauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaaaugucucagccccucguucuugguccugucccuuggaaccuuuguacgcuuugcucaaaaaaaaacaaaaaaaaaaaacaaaaaaaaaaaacaacgguggagccuucgcacucaaugccaacuuuuuguuacagauuaauuuuuccauaaaaccauuuuuugaaccaaucaguaauuuuaagguuuuguuuguucuaaauguaagaguucagacucacauucuauuaaaauuuagcccuaaaaugacaagccuucuuaaagccuuauuuuucaaaagcgccccccccauucuuguucagauuaagaguugccaaaauaccuucugaacuacacugcauuguugugccgagaacaccgagcacugaacuuugcaaagaccuucgucuuugagaagacgguagcuucugcaguuaggaggugcagacacuugcucuccuauguaguucucagaugcguaaagcagaacagccucccgaaugaagcguugccauugaacucaccagugaguuagcagcacguguucccgacauaacauuguacuguaauggagugagcguagcagcucagcucuuuggaucagucuuugugauuucauagcgaguuuucugaccagcuuuugcggagauuuugaacagaacugcuauuuccucuaaugaagaauucuguuuagcugugggugugccggguggggugugugugaucaaaggacaaagacaguauuuugacaaaauacgaaguggagauuuacacuacauuguacaaggaaugaaagugucacggguaaaaacucuaaaagguuaauuucugucaaaugcaguagaugaugaaagaaagguugguauuaucaggaaauguuuucuuaagcuuuuccuuucucuuacaccugccaugccuccccaaauugggcauuuaauucaucuuuaaacugguuguucuguuagucgcuaacuuaguaagugcuuuucuuauagaaccccuucugacugagcaauaugccuccuuguauuauaaaaucuuucugauaaugcauuagaagguuuuuuugucgauuaguaaaagugcuuuccauguuacuuuauucagagcuaauaagugcuuuccuuaguuuucuaguaacuagguguaaaaaucauguguugcagcuuuauaguuuuuaaaauauuuuagauaauucuuaaacuaugaaccuucuuaacaucacugucuugccagauuaccgacacugucacuugaccaauacugacccucuuuaccucgcccacgcggacacacgccuccuguagucgcuuugccuauugauguuccuuugggucugugagguucuguaaacugugcuagugcugacgauguucuguacaacuuaacucacuggcgagaauacagcgugggacccuucagccacuacaacagaauuuuuuaaauugacaguugcagaauuguggaguguuuuuacauugaucuuuugcuaaugcaauuagcauuauguuuugcauguaugacuuaauaaauccuugaaucaua

SEQ ID NO: 91 - RNA, 7134 nt, Homo_Sapiens
cgggcuugugccgccgccgccgccgccgccgcccgggccaagugacaaaggaaggaaggaagcgaggaggagccggccccgcagccgcugacagggcucugggcuggggcaaagcgcggacacuuccugagcgggcaccgagcagagccgaggggcgggagggcggccgagcuguugccgcggacgggggagggggccccgagggacggaagcgguugccggguucccauguccccggcgaauggggaacagucgaggagccgcugccuggggucugaagggagcugccuccgccaccgccauggccgcuggauccagccgccgccugcagcugcuccuggcgcaaugaggagaggagccgccgccaccgccaccgcccgccucugacugacucgcgacuccgccgcccucuaguucgccgggccccugccgucagcccgccggaucccgcggcuugccggagcugcagcguuucccgucgcaucuccgagccacccccucccucccucucccucccuccuacccaucccccuuucucuucaagcgugagacucgugauccuuccgccgcuucccuucuucauugacucggaaaaaaaauccccgaggaaaauauaauauucgaaguacucauuuucaaucaaguauuugcccccguuucacgugauacauauuuuuuuaggauuugcccucucuuuucucuccucccaggaaagggaggggaaagaauuguauuuuuucccaaguccuaaaucaucuauauguuaaauauccgugccgaucugucuugaaggagaaauauaucgcuuguuuuguuuuuuauaguauacaaaaggagugaaaagccaagaggacgaagucuuuuucuuuuucuucugugggagaacuuaaugcugcauuuaucguuaaccuaacaccccaacauaaagacaaaaggaagaaaaggaggaaggaaggaaaaggugauucgcgaagagagugaucaugucagggcggcccagaaccaccuccuuugcggagagcugcaagccggugcagcagccuucagcuuuuggcagcaugaaaguuagcagagacaaggacggcagcaaggugacaacagugguggcaacuccugggcaggguccagacaggccacaagaagucagcuauacagacacuaaagugauuggaaauggaucauuuggugugguauaucaagccaaacuuugugauucaggagaacuggucgccaucaagaaaguauugcaggacaagagauuuaagaaucgagagcuccagaucaugagaaagcuagaucacuguaacauaguccgauugcguuauuucuucuacuccaguggugagaagaaagaugaggucuaucuuaaucuggugcuggacuauguuccggaaacaguauacagaguugccagacacuauagucgagccaaacagacgcucccugugauuuaugucaaguuguauauguaucagcuguuccgaaguuuagccuauauccauuccuuuggaaucugccaucgggauauuaaaccgcagaaccucuuguuggauccugauacugcuguauuaaaacucugugacuuuggaagugcaaagcagcugguccgaggagaacccaauguuucguauaucuguucucgguacuauagggcaccagaguugaucuuuggagccacugauuauaccucuaguauagauguauggucugcuggcuguguguuggcugagcuguuacuaggacaaccaauauuuccaggggauagugguguggaucaguugguagaaauaaucaagguccugggaacuccaacaagggagcaaaucagagaaaugaacccaaacuacacagaauuuaaauucccucaaauuaaggcacauccuuggacuaaggauucgucaggaacaggacauuucaccucaggagugcgggucuuccgaccccgaacuccaccggaggcaauugcacuguguagccgucugcuggaguauacaccaacugcccgacuaacaccacuggaagcuugugcacauucauuuuuugaugaauuacgggacccaaaugucaaacuaccaaaugggcgagacacaccugcacucuucaacuucaccacucaagaacugucaaguaauccaccucuggcuaccauccuuauuccuccucaugcucggauucaagcagcugcuucaacccccacaaaugccacagcagcgucagaugcuaauacuggagaccguggacagaccaauaaugcugcuucugcaucagcuuccaacuccaccugaacagucccgagcagccagcugcacaggaaaaaccaccaguuacuugagugucacucagcaacacuggucacguuuggaaagaauauuaaaaagagaaaaaaauccuguucauuuuaguguucaauuuuuuuauuauuauuguuguucuuauuuaaccuuguaaaauaucuauaaauacaaaccaauuucauuguauucucacuuugagggagauccagggggugggagggguuguggggagggggaaagcggagcacuagaacauacaaucucucucccacgacaaucuuuuuuuauuaaaagucugcuguuguauacuuuaaaaacaggacuccugccucaugccccuuccacaaaagaagaaaaccuuuuucugugcugauggguuuuuuugaacuuuguuuucuuuuaaagucuagugugagacuuugguauagugcacagcuugaaauugguugggagcuuagcagguauaacucaacggggacuuaaaugucacuuguaaaauuaauccauaucuucggguauuuauagacuugccuuuggcauguugguggcagguguggcagacaaagaaauguguaucauucguaacccagggaggucaauaaaguuuggaacucuacagggaagauucuuaguagauuuguuaagguuuuguuuugcucucaguuagugcuagugauguagaggcuuguacaggaggcugccagaggggaagcagcaagcaagacucaggcacacaugcucuacagguggcucuuuguuugccugaccaaaguucuuugcaaaucuuagcacaguuucaaacuagugaccugggaggagauggaagggguguugagcaggcugagcuagcugcugaggucaaaggcugaugagcccagaggaaggggacaggucagggauacaucucaccacugugaauaaguuuguccagauuuuuuucuaaaguuacuucccuuggaaagauacacuugagaggacauuguaguuaaauaaugugaacuguaacagucaucuacugguuuauuuuucauauuuuuuaauugaaaauugagcuugcagaaauagccacauucuacacauaguucuaauuuuaaauccaaaucuagaaucuguauuuaauuuguuuuuuaaccucaugcuuuuuacauuuauuuauugaugcaugucagaugguagaaauauuaaaaacuacacaucagaaugauacagucacuuauaccugcugacuuuauaggaaagcugaugauauaaauguguguauauauguuauauauacauauauucaauacugccuuuuuuuuugucuacaguaucaaaauugacugguugaagcaugagaagaauguuucccccacacccaguuaagaguuuuugugucuguuuucuuuguguaucagugaacgauguuaagaaucagucucucuuuuugaagaaaaagcaauauuccuuggaaagcaaggagaauugaaggacuauguuugccgugaggaaauagauuuucaugacuaguuuguuuuauacuuuuaagguuggcaucuaugugggccuuauauacucuaaaaugaacuuuagucaccuuggugcuuaugggccauuacuugaccuaugaaucuuuaaggcacaaucaguuguacuuuacauuuaaagaucacuugagugauggccgccuuucccuccuacccgcuccuuccccacaugccuuccaagguuagcugguaacuguagggcugcagagcugagcccaugguuguguguaacuugcccucacccuccucauugccaccuuaggucacuuuaugggucucguccuccagaggguucggaaguggagucuguuggcagcccuccugcaggcccuagcacccuguccugcuccuuaacugugugugugacucuccaagagaguuguccugccugcugaagugaaccaguacccagaaagacaacugugagccaucuugguuuucacucgcuguuuagcugaggucuugggccacaaaagggguuucacaaaccucuggauauaucagaguuuaugagaaaggaaacaugcucagucaaaccaaaucaaacaaauugaauuuuauguuuuauaaagugcuucugaaagcuaagauuugaaagaagucugaaaucaaaguauuuggcagcauaacuccuuaaagguaguggcguugauagaccauuuucagacagaauuuauaaagaaucugaaaaggcaggucugugauagagaaauggaccugcauucagauccaacugcccagcaagcguuuggaugcagacacugcucuggacgugguauacuccccagaguccauaaaaaucagugcuuauuuuaggaaacagguugccccccacaacugggguaaaagaagagagaaaagucacgcuuuucucucauuucauugugugugcaugugugcgugugugugugugugugugugugcugagaugugugauuuuucuuucucaaggaucauggugggaucacagaacucuuuuauacaagugagauccaggucucugaauaucuuuuuguauauaauaauaauaaaaagcuccucaccaaauucaagcuuguacauuauauuuucuuucuguguuuuuaaauuuaaguuuuauuguuuuguauguaaauauguggacccaggaacuguuauuaaugagcaaaaaguuacuguucagggcagugauucuguuuaauaaucagacaaaauguagacgagcuuuuuaaagccauauaguuuuaacucuguacaguagguaccggccuguauuauuguaacaauaacucuagcaauguauaguguaucuauauaguuuggagugccuucgcuuccauguguuuuuuuuuuuaauuuguucuuuuuuaaauuuuaauugguuuccuuuauccaugucucccuguccacccccuuucccuuugaaauaauaacucacucauaacaguaucuuugccccuuccacaguuaaguuucagugauaccauacucaggagugggaagaggaaaucauauucguaauuucauuucguugaagcccugccuuuguuuugguucugaaugucuuuccuccucgguagcagugagaccgguuucauuucauacuuaguccauucagggacuuaguguagcaccagggagcccuagagcuggaggauaucgaauagauuaaauuuugcucgucucuuccacaagcccuaaccaugggucuuaaaaacagcagauucugggagccuuccaugcucucucucucuccucuuuuaucuacuucccucccaaaugagagagugacagagaauuguuuuuuuauaaaucgaaguuucuuaauaguaucagguuuugauacgucaguggucuaaaaugcuauagugcaauuacuagcaguuacugcacggagugccaccgugccaauagaggacuguuguuuuaacaagggaacucuuagcccauuuccucccucccgccaucucuacccuugcucaaugaaauaucauuuuaauuucuuuuaaaaaaaaucaguuuaauucuuacugugugcccaacacgaaggccuuuuuugaaagaaaaauagaauguuuugccucaaaguaguccauauaaaaugucuugaauagaagaaaaaacuaccaaaccaaagguuacuauuuuugaaacaucguguguucauuccagcaaggcagaagacugcaccuucuuuccagugacaugcugugucauuuuuuuuaaguccucuuaauuuuuagacacauuuuugguuuauguuuuaacaauguaugccuaaccagucaucuugucugcaccaaugcaaagguuucugagaggaguauucucuaucccuguggauaugaagacacuggcauuucaucuauuuuucccuuuccuuuuuaaaggauuuaacuuuggaaucuuccaaaggaaguuuggccaaugccagauccccaggaauuugggggguuuucuuucuuuucaacugaaauuguaucugauuccuacuguucauguuagugaucaucuaaucacagagccaaacacuuuucuccccuguguggaaaaguagguaugcuuuacaauaaaaucugucuuuucugguagaaaccugagccacugaaaauaaaagagacaacuagaagcacaguagagucccagacugagaucuaccuuugagaggcuuugaaaguaaucccugggguuuggauuauuuucacaaggguuaugccguuuuauucaaguuuguugcuccguuuugcaccucugcaauaaaagcaaaaugacaaccaguacauaagggguuagcuugacaaaguagacuuccuuguguuaauuuuuaaguuuuuuuuuccuuaacuauaucugucuacaggcagauacagauaguuguaugaaaaucugcuugccuguaaaauuugcauuuauaaauguguugccgauggaucacuugggccuguacacauaccaauuagcgugaccacuuccaucuuaaaaacaaaccuaaaaaacaaaauuuauuauauauauauauauauauauauaaaggacuguggguuguauacaaacuauugcaaacacuugugcaaaucugucuugauauaaaggaaaagcaaaaucuguauaacauuauuacuacuugaaugccucugugacugauuuuuuuuucauuuuaaauauaaacuuuuuugugaaaaguaugcucaauguuuuuuuucccuuuccccauucccuuguaaauacauuuuguucuaugugacuugguuuggaaauaguuaacugguacuguaauuugcauuaaauaaaaaguagguuagccuggaaaugaaauuaaaaaaaaaaaaaaaaaa

SEQ ID NO: 92 - RNA, 7095 nt, Homo_Sapiens
cgggcuugugccgccgccgccgccgccgccgcccgggccaagugacaaaggaaggaaggaagcgaggaggagccggccccgcagccgcugacagggcucugggcuggggcaaagcgcggacacuuccugagcgggcaccgagcagagccgaggggcgggagggcggccgagcuguugccgcggacgggggagggggccccgagggacggaagcgguugccggguucccauguccccggcgaauggggaacagucgaggagccgcugccuggggucugaagggagcugccuccgccaccgccauggccgcuggauccagccgccgccugcagcugcuccuggcgcaaugaggagaggagccgccgccaccgccaccgcccgccucugacugacucgcgacuccgccgcccucuaguucgccgggccccugccgucagcccgccggaucccgcggcuugccggagcugcagcguuucccgucgcaucuccgagccacccccucccucccucucccucccuccuacccaucccccuuucucuucaagcgugagacucgugauccuuccgccgcuucccuucuucauugacucggaaaaaaaauccccgaggaaaauauaauauucgaaguacucauuuucaaucaaguauuugcccccguuucacgugauacauauuuuuuuaggauuugcccucucuuuucucuccucccaggaaagggaggggaaagaauuguauuuuuucccaaguccuaaaucaucuauauguuaaauauccgugccgaucugucuugaaggagaaauauaucgcuuguuuuguuuuuuauaguauacaaaaggagugaaaagccaagaggacgaagucuuuuucuuuuucuucugugggagaacuuaaugcugcauuuaucguuaaccuaacaccccaacauaaagacaaaaggaagaaaaggaggaaggaaggaaaaggugauucgcgaagagagugaucaugucagggcggcccagaaccaccuccuuugcggagagcugcaagccggugcagcagccuucagcuuuuggcagcaugaaaguuagcagagacaaggacggcagcaaggugacaacagugguggcaacuccugggcaggguccagacaggccacaagaagucagcuauacagacacuaaagugauuggaaauggaucauuuggugugguauaucaagccaaacuuugugauucaggagaacuggucgccaucaagaaaguauugcaggacaagagauuuaagaaucgagagcuccagaucaugagaaagcuagaucacuguaacauaguccgauugcguuauuucuucuacuccaguggugagaagaaagaugaggucuaucuuaaucuggugcuggacuauguuccggaaacaguauacagaguugccagacacuauagucgagccaaacagacgcucccugugauuuaugucaaguuguauauguaucagcuguuccgaaguuuagccuauauccauuccuuuggaaucugccaucgggauauuaaaccgcagaaccucuuguuggauccugauacugcuguauuaaaacucugugacuuuggaagugcaaagcagcugguccgaggagaacccaauguuucguauaucuguucucgguacuauagggcaccagaguugaucuuuggagccacugauuauaccucuaguauagauguauggucugcuggcuguguguuggcugagcuguuacuaggacaaccaauauuuccaggggauagugguguggaucaguugguagaaauaaucaagguccugggaacuccaacaagggagcaaaucagagaaaugaacccaaacuacacagaauuuaaauucccucaaauuaaggcacauccuuggacuaaggucuuccgaccccgaacuccaccggaggcaauugcacuguguagccgucugcuggaguauacaccaacugcccgacuaacaccacuggaagcuugugcacauucauuuuuugaugaauuacgggacccaaaugucaaacuaccaaaugggcgagacacaccugcacucuucaacuucaccacucaagaacugucaaguaauccaccucuggcuaccauccuuauuccuccucaugcucggauucaagcagcugcuucaacccccacaaaugccacagcagcgucagaugcuaauacuggagaccguggacagaccaauaaugcugcuucugcaucagcuuccaacuccaccugaacagucccgagcagccagcugcacaggaaaaaccaccaguuacuugagugucacucagcaacacuggucacguuuggaaagaauauuaaaaagagaaaaaaauccuguucauuuuaguguucaauuuuuuuauuauuauuguuguucuuauuuaaccuuguaaaauaucuauaaauacaaaccaauuucauuguauucucacuuugagggagauccagggggugggagggguuguggggagggggaaagcggagcacuagaacauacaaucucucucccacgacaaucuuuuuuuauuaaaagucugcuguuguauacuuuaaaaacaggacuccugccucaugccccuuccacaaaagaagaaaaccuuuuucugugcugauggguuuuuuugaacuuuguuuucuuuuaaagucuagugugagacuuugguauagugcacagcuugaaauugguugggagcuuagcagguauaacucaacggggacuuaaaugucacuuguaaaauuaauccauaucuucggguauuuauagacuugccuuuggcauguugguggcagguguggcagacaaagaaauguguaucauucguaacccagggaggucaauaaaguuuggaacucuacagggaagauucuuaguagauuuguuaagguuuuguuuugcucucaguuagugcuagugauguagaggcuuguacaggaggcugccagaggggaagcagcaagcaagacucaggcacacaugcucuacagguggcucuuuguuugccugaccaaaguucuuugcaaaucuuagcacaguuucaaacuagugaccugggaggagauggaagggguguugagcaggcugagcuagcugcugaggucaaaggcugaugagcccagaggaaggggacaggucagggauacaucucaccacugugaauaaguuuguccagauuuuuuucuaaaguuacuucccuuggaaagauacacuugagaggacauuguaguuaaauaaugugaacuguaacagucaucuacugguuuauuuuucauauuuuuuaauugaaaauugagcuugcagaaauagccacauucuacacauaguucuaauuuuaaauccaaaucuagaaucuguauuuaauuuguuuuuuaaccucaugcuuuuuacauuuauuuauugaugcaugucagaugguagaaauauuaaaaacuacacaucagaaugauacagucacuuauaccugcugacuuuauaggaaagcugaugauauaaauguguguauauauguuauauauacauauauucaauacugccuuuuuuuuugucuacaguaucaaaauugacugguugaagcaugagaagaauguuucccccacacccaguuaagaguuuuugugucuguuuucuuuguguaucagugaacgauguuaagaaucagucucucuuuuugaagaaaaagcaauauuccuuggaaagcaaggagaauugaaggacuauguuugccgugaggaaauagauuuucaugacuaguuuguuuuauacuuuuaagguuggcaucuaugugggccuuauauacucuaaaaugaacuuuagucaccuuggugcuuaugggccauuacuugaccuaugaaucuuuaaggcacaaucaguuguacuuuacauuuaaagaucacuugagugauggccgccuuucccuccuacccgcuccuuccccacaugccuuccaagguuagcugguaacuguagggcugcagagcugagcccaugguuguguguaacuugcccucacccuccucauugccaccuuaggucacuuuaugggucucguccuccagaggguucggaaguggagucuguuggcagcccuccugcaggcccuagcacccuguccugcuccuuaacugugugugugacucuccaagagaguuguccugccugcugaagugaaccaguacccagaaagacaacugugagccaucuugguuuucacucgcuguuuagcugaggucuugggccacaaaagggguuucacaaaccucuggauauaucagaguuuaugagaaaggaaacaugcucagucaaaccaaaucaaacaaauugaauuuuauguuuuauaaagugcuucugaaagcuaagauuugaaagaagucugaaaucaaaguauuuggcagcauaacuccuuaaagguaguggcguugauagaccauuuucagacagaauuuauaaagaaucugaaaaggcaggucugugauagagaaauggaccugcauucagauccaacugcccagcaagcguuuggaugcagacacugcucuggacgugguauacuccccagaguccauaaaaaucagugcuuauuuuaggaaacagguugccccccacaacugggguaaaagaagagagaaaagucacgcuuuucucucauuucauugugugugcaugugugcgugugugugugugugugugugugcugagaugugugauuuuucuuucucaaggaucauggugggaucacagaacucuuuuauacaagugagauccaggucucugaauaucuuuuuguauauaauaauaauaaaaagcuccucaccaaauucaagcuuguacauuauauuuucuuucuguguuuuuaaauuuaaguuuuauuguuuuguauguaaauauguggacccaggaacuguuauuaaugagcaaaaaguuacuguucagggcagugauucuguuuaauaaucagacaaaauguagacgagcuuuuuaaagccauauaguuuuaacucuguacaguagguaccggccuguauuauuguaacaauaacucuagcaauguauaguguaucuauauaguuuggagugccuucgcuuccauguguuuuuuuuuuuaauuuguucuuuuuuaaauuuuaauugguuuccuuuauccaugucucccuguccacccccuuucccuuugaaauaauaacucacucauaacaguaucuuugccccuuccacaguuaaguuucagugauaccauacucaggagugggaagaggaaaucauauucguaauuucauuucguugaagcccugccuuuguuuugguucugaaugucuuuccuccucgguagcagugagaccgguuucauuucauacuuaguccauucagggacuuaguguagcaccagggagcccuagagcuggaggauaucgaauagauuaaauuuugcucgucucuuccacaagcccuaaccaugggucuuaaaaacagcagauucugggagccuuccaugcucucucucucuccucuuuuaucuacuucccucccaaaugagagagugacagagaauuguuuuuuuauaaaucgaaguuucuuaauaguaucagguuuugauacgucaguggucuaaaaugcuauagugcaauuacuagcaguuacugcacggagugccaccgugccaauagaggacuguuguuuuaacaagggaacucuuagcccauuuccucccucccgccaucucuacccuugcucaaugaaauaucauuuuaauuucuuuuaaaaaaaaucaguuuaauucuuacugugugcccaacacgaaggccuuuuuugaaagaaaaauagaauguuuugccucaaaguaguccauauaaaaugucuugaauagaagaaaaaacuaccaaaccaaagguuacuauuuuugaaacaucguguguucauuccagcaaggcagaagacugcaccuucuuuccagugacaugcugugucauuuuuuuuaaguccucuuaauuuuuagacacauuuuugguuuauguuuuaacaauguaugccuaaccagucaucuugucugcaccaaugcaaagguuucugagaggaguauucucuaucccuguggauaugaagacacuggcauuucaucuauuuuucccuuuccuuuuuaaaggauuuaacuuuggaaucuuccaaaggaaguuuggccaaugccagauccccaggaauuugggggguuuucuuucuuuucaacugaaauuguaucugauuccuacuguucauguuagugaucaucuaaucacagagccaaacacuuuucuccccuguguggaaaaguagguaugcuuuacaauaaaaucugucuuuucugguagaaaccugagccacugaaaauaaaagagacaacuagaagcacaguagagucccagacugagaucuaccuuugagaggcuuugaaaguaaucccugggguuuggauuauuuucacaaggguuaugccguuuuauucaaguuuguugcuccguuuugcaccucugcaauaaaagcaaaaugacaaccaguacauaagggguuagcuugacaaaguagacuuccuuguguuaauuuuuaaguuuuuuuuuccuuaacuauaucugucuacaggcagauacagauaguuguaugaaaaucugcuugccuguaaaauuugcauuuauaaauguguugccgauggaucacuugggccuguacacauaccaauuagcgugaccacuuccaucuuaaaaacaaaccuaaaaaacaaaauuuauuauauauauauauauauauauauaaaggacuguggguuguauacaaacuauugcaaacacuugugcaaaucugucuugauauaaaggaaaagcaaaaucuguauaacauuauuacuacuugaaugccucugugacugauuuuuuuuucauuuuaaauauaaacuuuuuugugaaaaguaugcucaauguuuuuuuucccuuuccccauucccuuguaaauacauuuuguucuaugugacuugguuuggaaauaguuaacugguacuguaauuugcauuaaauaaaaaguagguuagccuggaaaugaaauuaaaaaaaaaaaaaaaaaa

SEQ ID NO: 93 - RNA, 3155 nt, Homo_Sapiens
guuucauuuugcaguuacugggagggggcuugcuguggcccugucaggaagaguagagcucugguccagcuccgcgcagggagggaggcugucaccaugccggccugcugcagcugcagugauguuuuccaguaugagacgaacaaagucacucggauccagagcaugaauuauggcaccauuaagugguucuuccacgugaucaucuuuuccuacguuugcuuugcucuggugagugacaagcuguaccagcggaaagagccugucaucaguucugugcacaccaaggugaaggggauagcagaggugaaagaggagaucguggagaauggagugaagaaguuggugcacagugucuuugacaccgcagacuacaccuucccuuugcaggggaacucuuucuucgugaugacaaacuuucucaaaacagaaggccaagagcagcgguugugucccgaguaucccacccgcaggacgcucuguuccucugaccgagguuguaaaaagggauggauggacccgcagagcaaaggaauucagaccggaagguguguaguguaugaagggaaccagaagaccugugaagucucugccuggugccccaucgaggcaguggaagaggccccccggccugcucucuugaacagugccgaaaacuucacugugcucaucaagaacaauaucgacuuccccggccacaacuacaccacgagaaacauccugccagguuuaaacaucacuuguaccuuccacaagacucagaauccacagugucccauuuuccgacuaggagacaucuuccgagaaacaggcgauaauuuuucagauguggcaauucagggcggaauaaugggcauugagaucuacugggacugcaaccuagaccguugguuccaucacugccgucccaaauacaguuuccgucgccuugacgacaagaccaccaacguguccuuguacccuggcuacaacuucagauacgccaaguacuacaaggaaaacaauguugagaaacggacucugauaaaagucuucgggauccguuuugacauccugguuuuuggcaccggaggaaaauuugacauuauccagcugguuguguacaucggcucaacccucuccuacuucggucuggccgcuguguucaucgacuuccucaucgacacuuacuccaguaacugcugucgcucccauauuuaucccuggugcaagugcugucagcccuguguggucaacgaauacuacuacaggaagaagugcgaguccauuguggagccaaagccgacauuaaaguauguguccuuuguggaugaaucccacauuaggauggugaaccagcagcuacuagggagaagucugcaagaugucaagggccaagaagucccaagaccugcgauggacuucacagauuuguccaggcugccccuggcccuccaugacacacccccgauuccuggacaaccagaggagauacagcugcuuagaaaggaggcgacuccuagauccagggauagccccgucuggugccaguguggaagcugccucccaucucaacucccugagagccacaggugccuggaggagcugugcugccggaaaaagccgggggccugcaucaccaccucagagcuguucaggaagcugguccuguccagacacguccugcaguuccuccugcucuaccaggagcccuugcuggcgcuggauguggauuccaccaacagccggcugcggcacugugccuacaggugcuacgccaccuggcgcuucggcucccaggacauggcugacuuugccaaccugcccagcugcugccgcuggaggauccggaaagaguuuccgaagagugaagggcaguacaguggcuucaagaguccuuacugaagccaggcaccguggcucacgucuguaaucccagcgcuuugggaggccgaggcaggcagaucaccugaggucgggaguuggagacccgccuggcuaacaaggcgaaauccugucuguacuaaaaauacaaaaaucagccagacaugguggcaugcaccugcaaucccagcuacucgggaggcugaggcacaagaaucacuugaacccgggaggcagagguuguagugagcccagauugugccacugcucuccagccugggaggcacagcaaacugucccccaaaaaaaaaaaagaguccuuaccaauagcaggggcugcaguagccauguuaacaugacauuuaccagcaacuugaacuucaccugcaaagcucuguggccacauuuucagccaaagggaaauaugcuuucaucuucuguugcucucugugucugagagcaaagugaccugguuaaacaaaccagaaucccucuacauggacucagagaaaagagauugagauguaagucucaacucuguccccaggaaguugugugacccuaggccucucaccucugugccucugucuccuuguugcccaacuacuaucucagagauauugugaggacaaauugagacagugcacaugaacugucuuuuaauguguaaagaucuacaugaaugcaaaacauuucauuaugaggucagacuaggauaauguccaacuaaaaacaaacccuuuucauccuggcuggagaauguggagaacuaaagguggccacaaauucuuugacacucaagucccccaagaccuaaggguuuuaucuccuccccuugaauauggguggcucugauugcuuuauccaaaaguggaagugacauugugucaguuucagauccugaucuuaagaggcugacagcuucuacuugcugucccuuggaacucuugcuaucggggaagccagacgccauuuaaaagucugccuauccuggccaggugugguggcucacaccuguaaucccagcacuuugggagaccaaggcgggcggaucacuuaaagucaggaguccaagaccagacucgccaacauggugaaaccguaucucuaauaaaaauacaaaaauuagcugggcauggugcgggcaccuguaguccuagcuaucaagaggcugagacaggagaaacacuugaaccugggagguggagguugcauugagcugagaucgugccacugcacuccaggcugggugacagagcgagacuccaucucaaaaaaaaaaaaaagaaaaa

SEQ ID NO: 94 - RNA, 5876 nt, Homo_Sapiens
caaccaccccaugugucucuagaaccccaguguagcgagcuggagagaggacuguccugagggcagcaggccugguugcagcuggcgugggggucucagaauggagcccucagcccugaggaaagcuggcucggagcaggaggagggcuuugaggggcugcccagaagggucacugaccuggggauggucuccaaucuccggcgcagcaacagcagccucuucaagagcuggaggcuacagugccccuucggcaacaaugacaagcaagaaagccucaguucguggauuccugaaaacaucaagaagaaagaaugcguguauuuuguggaaaguuccaaacugucugaugcugggaagguggugugucaguguggcuacacgcaugagcagcacuuggaggaggcuaccaagccccacaccuuccagggcacacagugggacccaaagaaacauguccaggagaugccaaccgaugccuuuggcgacaucgucuucacgggccugagccagaaggugaaaaaguacguccgagucucccaggacacgcccuccagcgugaucuaccaccucaugacccagcacugggggcuggacguccccaaucucuugaucucggugaccgggggggccaagaacuucaacaugaagccgcggcugaagagcauuuuccgcagaggccuggucaagguggcucagaccacaggggccuggaucaucacaggggggucccacaccggcgucaugaagcagguaggcgaggcggugcgggacuucagccugagcagcagcuacaaggaaggcgagcucaucaccaucggagucgccaccuggggcacuguccaccgccgcgagggccugauccaucccacgggcagcuuccccgccgaguacauacuggaugaggauggccaagggaaccugaccugccuagacagcaaccacucucacuucauccucguggacgacgggacccacggccaguacgggguggagauuccucugaggaccaggcuggagaaguucauaucggagcagaccaaggaaagaggagguguggccaucaagauccccaucgugugcguggugcuggagggcggcccgggcacguugcacaccaucgacaacgccaccaccaacggcacccccugugugguuguggagggcucgggccgcguggccgacgucauugcccagguggccaaccugccugucucggacaucacuaucucccugauccagcagaaacugagcguguucuuccaggagauguuugagaccuucacggaaagcaggauugucgaguggaccaaaaagauccaagauaucguccggaggcggcagcugcugacugucuuccgggaaggcaaggauggucagcaggacguggauguggccaucuugcaggccuugcugaaagccucacggagccaagaccacuuuggccacgagaacugggaccaccagcugaaacuggcaguggcauggaaucgcguggacauugcccgcagugagaucuucauggaugaguggcaguggaagccuucagaucugcaccccacgaugacagcugcacucaucuccaacaagccugaguuugugaagcucuuccuggagaacggggugcagcugaaggaguuugucaccugggacaccuugcucuaccuguacgagaaccuggaccccuccugccuguuccacagcaagcugcagaaggugcugguggaggaucccgagcgcccggcuugcgcgcccgcggcgccccgccugcagaugcaccacguggcccaggugcugcgggagcugcugggggacuucacgcagccgcuuuauccccggccccggcacaacgaccggcugcggcuccugcugcccguuccccacgucaagcucaacgugcagggagugagccuccggucccucuacaagcguuccucaggccaugugaccuucaccauggaccccauccgugaccuucucauuugggccauuguccagaaccgucgggagcuggcaggaaucaucugggcucagagccaggacugcaucgcagcggccuuggccugcagcaagauccugaaggaacuguccaaggaggaggaggacacggacagcucggaggagaugcuggcgcuggcggaggaguaugagcacagagccaucggggucuucaccgagugcuaccggaaggacgaagagagagcccagaaacugcucacccgcguguccgaggccugggggaagaccaccugccugcagcucgcccuggaggccaaggacaugaaguuugugucucacgggggcauccaggccuuccugaccaaggugugguggggccagcucuccguggacaaugggcuguggcgugugacccugugcaugcuggccuucccgcugcuccucaccggccucaucuccuucagggagaagaggcugcaggaugugggcacccccgcggcccgcgcccgugccuucuucaccgcacccgugguggucuuccaccugaacauccucuccuacuucgccuuccucugccuguucgccuacgugcucaugguggacuuccagccugugcccuccuggugcgagugugccaucuaccucuggcucuucuccuuggugugcgaggagaugcggcagcucuucuaugacccugacgagugcgggcugaugaagaaggcagccuuguacuucagugacuucuggaauaagcuggacgucggcgcaaucuugcucuucguggcagggcugaccugcaggcucaucccggcgacgcuguaccccgggcgcgucauccucucucuggacuucauccuguucugccuccggcucaugcacauuuuuaccaucaguaagacgcuggggcccaagaucaucauugugaagcggaugaugaaggacgucuucuucuuccucuuccugcuggcugugugggugguguccuucgggguggccaagcaggccauccucauccacaacgagcgccggguggacuggcuguuccgaggggccgucuaccacuccuaccucaccaucuucgggcagaucccgggcuacaucgacggugugaacuucaacccggagcacugcagccccaauggcaccgaccccuacaagccuaagugccccgagagcgacgcgacgcagcagaggccggccuucccugaguggcugacgguccuccuacucugccucuaccugcucuucaccaacauccugcugcucaaccuccucaucgccauguucaacuacaccuuccagcaggugcaggagcacacggaccagauuuggaaguuccagcgccaugaccugaucgaggaguaccacggccgccccgccgcgccgccccccuucauccuccucagccaccugcagcucuucaucaagagggugguccugaagacuccggccaagaggcacaagcagcucaagaacaagcuggagaagaacgaggaggcggcccugcuauccugggagaucuaccugaaggagaacuaccuccagaaccgacaguuccagcaaaagcagcggcccgagcagaagaucgaggacaucagcaauaagguugacgccaugguggaccugcuggaccuggacccacugaagaggucgggcuccauggagcagagguuggccucccuggaggagcagguggcccagacagcccgagcccugcacuggaucgugaggacgcugcgggccagcggcuucagcucggaggcggacguccccacucuggccucccagaaggccgcggaggagccggaugcugagccgggaggcaggaagaagacggaggagccgggcgacagcuaccacgugaaugcccggcaccuccucuaccccaacugcccugucacgcgcuuccccgugcccaacgagaaggugcccugggagacggaguuccugaucuaugacccacccuuuuacacggcagagaggaaggacgcggccgccauggaccccaugggagacacccuggagccacuguccacgauccaguacaacgugguggauggccugagggaccgccggagcuuccacgggccguacacagugcaggccggguugccccugaaccccaugggccgcacaggacugcgugggcgcgggagccucagcugcuucggacccaaccacacgcuguaccccauggucacgcgguggaggcggaacgaggauggagccaucugcaggaagagcauaaagaagaugcuggaagugcugguggugaagcucccucucuccgagcacugggcccugccugggggcucccgggagccaggggagaugcuaccucggaagcugaagcggauccuccggcaggagcacuggccgucuuuugaaaacuugcugaagugcggcauggagguguacaaaggcuacauggaugacccgaggaacacggacaaugccuggaucgagacgguggccgucagcguccacuuccaggaccagaaugacguggagcugaacaggcugaacucuaaccugcacgccugcgacucgggggccuccauccgauggcaggugguggacaggcgcaucccacucuaugcgaaccacaagacccuccuccagaaggcagccgcugaguucggggcucacuacugacugugcccucaggcugggcggcuccaguccauagacguuccccccagaaaccagggcuucucucuccugagccuggccaggacucaggcuguuccugggcccugcacaugaugggguuugguggacccagugccccucacggcugccgcaagucugcugcagaugaccucaugaacuggaaggggucaaggugacccgggaggagagcucaagacagggcacaggcuacucagagcugaggggccccugggacccuuggccaucaggcgaggggcugggccugugcagcugggcccuuggccagaguccacucccuuccuggcugugucaccccgagcagcucauccaccauggaggucauuggccugaggcaaguuccccggagagucgggguccccuguggcccccucaggccuaugucugugaggaaggggcccugccacucuccccaagagggccuccauguuucgaggugccucaacauggagccuugccuggccugggcuaggggcacugucugaacuccugacugucaggauaaacuccguggggguacaggagcccagacaaagcccaggccugucaagagacgcagagggccccugccaggguuggccccagggacccugggacgaggcugcagaagcucucccucccuacucccugggagccacgugcuggccauguggccagggacggcaugagcaggaggcggggacgugggggccuucugguuuggugucaacagcucacaggagcgugaaccaugagggcccucaggaggggaacgugguaaaacccaagacauuaaaucugccaucucaggccuggcuggcucuucugugcuuuccacaaauaaaguuccugacacguccagggccaggggcugugugacggcugccugaaguucuccucgaucccccggugagcuuccugcagccuguggauguccugcagccccucagcccuacccccaaguuucuccucugacccaucagcucccugucuucauuuuccuaaaccugggcuccagcaucguccccaagcccaccaggccaggaugcaggcauccacaugcccuccuccuuggcuuccccugcgugguggugccaaugugcccuggcaccccugcagaggcuccggauggagccuggggcugccuggccacugagcacuggccgaggugaugcccacccuucccuggacaggccucugucuuccaccugacccaaagcucucuagccacccccuuguccccagguau

SEQ ID NO: 95 - RNA, 4276 nt, Homo_Sapiens
cgguggugggaaagugaacgaaucccgaaucaaagcggcgcauugaggcagguggggugccaguggaagagagaaagcaggcgaguguuuacggccugacuugggaggccggcggaucagcaauugcagaagcaggcagcggcagagagggaauggugcaggcaggcgcugagaaggacgcgcaguccaucucucucagguuagugaaaugaggcucuccgcccggggccggcccggggacagugcgcugcuggucccagcaugaaugcgggccccggcugugaacccugcaccaagcgaccccgcuggggcgccgcuacaacuucgccggcugcuucggacgcccggagcuuucccagcaggcagaggcgcguccucgaccccaaggacgcucacgugcaguucagggucccaccguccucgccagccugcgucccagggcgggcgggacagcacagaggcagcgccaccucgcuuguuuucaaacaaaagacuauuaccaguuggauggacacuaaaggaaucaagacagcggaaucagaaaguuuggauaguaaagaaaacaacaauacaagaauagaauccaugaugaguucuguacaaaaagauaacuuuuaccaacauaauguagaaaaauuagaaaauguuucucagcuaagucuugauaagucacccacugaaaaaaguacacaguauuugaaccagcaucagacugcagcaauguguaaguggcaaaaugaagggaaacacacggagcagcuuuuggaaagugaaccucaaacaguaacccugguaccagagcaguuuaguaaugcuaacauugaucggucaccucaaaaugaugaucacagugacacagauagugaagagaauagagacaaucaacaguuucucacaacuguaaagcuugcaaaugcaaagcagacuacggaagaugaacaggccagagaagccaaaagccaccagaagugcagcaagucuugcgauccuggggaagacugugcaaguugucagcaagaugagauagauguggugccagagaguccauugucagauguuggcucugaggauguugguacugggccaaaaaaugacaacaaauugacuagacaagaaaguugccuaggaaauucuccuccauuugagaaggaaagugaacccgagucaccgauggauguggauaauucuaaaaauaguugucaagacucagaagcagaugaggagacaaguccagguuuugaugaacaagaagaugguaguuccucccaaacagcaaauaaaccuucaagguuccaagcaagagacgcugacauugaauuuaggaaacgguacucuacuaagggcggugaaguuagauuacauuuccaauuugaaggaggagagagucgcacuggaaugaaugauuuaaaugcuaaacuaccuggaaauauuucuagccugaauguagaaugcagaaauucuaagcaacauggaaaaaaggauucuaaaaucacagaucauuucaugagacugcccaaagcagaggacagaagaaaagaacagugggaaaccaaacaucaaagaacagaaaggaagaucccuaaauacguuccaccucaccuuucuccagauaagaaguggcuuggaacucccauugaggagaugagaagaaugccucggugugggauccggcugccucucuugagaccaucugccaaucacacaguaacuauucggguagaucuuuugcgagcaggagaaguuccuaaaccuuuuccaacacauuauaaagauuugugggauaacaagcauguuaaaaugccuuguucagaacaaaauuuguacccaguggaagaugagaauggugagcgaacugcggggagccggugggagcucauucagacugcacuucucaacaaauuuacacgaccccaaaacuugaaggaugcuauucugaaauacaauguggcauauucuaagaaaugggacuuuacagcuuugaucgauuucugggauaagguacuugaagaagcagaagcucaacauuuauaucaguccaucuugccugauauggugaaaauugcacucugucugccaaauauuugcacccagccaauaccacuccugaaacagaagaugaaucauuccaucacaaugucgcaggaacagauugccagucuuuuagcuaaugcuuucuucugcacauuuccacgacgaaaugcuaagaugaaaucggaguauucuaguuacccagacauuaacuucaaucgauuguuugagggacguucaucaaggaaaccggagaaacuuaaaacgcucuucugcuacuuuagaagagucacagagaaaaaaccuacuggguuggugacauuuacaagacagagucuugaagauuuuccagaaugggaaagaugugaaaaacccuugacacgauugcaugucacuuacgaagguaccauagaagaaaauggccaaggcaugcuacagguggauuuugcaaaucguuuuguuggaggugguguaaccagugcaggacuugugcaagaagaaauccgcuuuuuaaucaauccugaguugauuauuucacggcucuucacugaggugcuggaucacaaugaaugucuaauuaucacagguacugagcaguacagugaauacacaggcuaugcugagacauaucguuggucccggagccacgaagaugggagugaaagggacgacuggcagcggcgcugcacugagaucguugccaucgaugcucuucacuucagacgcuaccucgaucaguuugugccugagaaaaugagacgcgagcugaacaaggcuuacuguggauuucuccguccuggaguuucuucagagaaucuuucugcaguggccacaggaaacuggggcuguggugccuuugggggugaugccagguuaaaagccuuaauacagauauuggcagcugcugcagcugagcgagaugugguuuauuucaccuuuggggacucagaauugaugagagacauuuacagcaugcacauuuuccuuacugaaaggaaacucacuguuggagauguguauaagcuguugcuacgauacuacaaugaagaaugcagaaacuguuccaccccuggaccagacaucaagcuuuauccauucauauaccaugcugucgaguccugugcagagaccgcugaccauucagggcaaaggacagggaccugaggagccgagcgaauagcaucuccucccaccucccaccagagacguccuguuugagcugucagguguaauauaugaauugacuuaaguuaauauaaauguguacauaauccacauuuguagucaaggacgcaaucucuuccacacaugugcaguugucaguugguacaucuaaacucccuccauccugacucacguggacuuagauauguuuuguuucuauuuucuucuauuucaguuuuucauucuuugauguuuauuucuuuuguccaucagaucucuugugaaaucccauggaagguugugcucagccugucgggucucuuucuuccugcccauauauuauaccaguugcuucugcagcccgcagaugccagcgaugccaggaaacaaguugaaauccaggaaucucuuuaacugauuuugcuaaaaaucucccugugagccuuccacucaacucuuaauaugcuugcauuguuuaaguuuuuaaauucugaaaauuaauaauuaggguuuuuuucauauguguugcauaaugcaaaccuccuagguuaaaauaguuucuuuauuuaagauagaauaauuuccagaaauuguacuuuugagguaucauuuuuaucuguaaugguuugucugucuuuuuuccucugaucaguauuuuuuuauaccaguuuuggagacuggcugagaugaaaggaaauguggaauaaaaggagguuuuccugaugugguguaaagaaaacagauucaagagaauugaagauuuuuuuuguuucuugguacuuuuuucuuuuuaaauuaggacuaauguuucuuuuguggugcuugaggcauauucauauaaccaaaguuugagaacugggaacuucaugcugauuuguacauauugaaguuucucugguauucaaagguuauauagugaaugaauuuucauuaauaaaucacuuugucagaaacucccauaucaucuauauuuuauauauguauauauaaacguaugcucuuuaagugugucuauaugugagcacauaaaaucuaaauaaaauuggacuggugggaaacaaaaaaaaaaaaaaaaaaaaaaaaa

SEQ ID NO: 96 - RNA, 1494 nt, Homo_Sapiens
agugaaacagaaggggaggugcaguuucagaacccagccagccucucucuugcugccuagccuccugccggccucaucuucgcccagccaaccccgccuggagcccuauggccaacugcgaguucagcccgguguccggggacaaacccugcugccggcucucuaggagagcccaacucugucuuggcgucaguauccugguccugauccucgucguggugcucgcgguggucgucccgagguggcgccagcaguggagcgguccgggcaccaccaagcgcuuucccgagaccguccuggcgcgaugcgucaaguacacugaaauucauccugagaugagacauguagacugccaaaguguaugggaugcuuucaagggugcauuuauuucaaaacauccuugcaacauuacugaagaagacuaucagccacuaaugaaguugggaacucagaccguaccuugcaacaagauucuucuuuggagcagaauaaaagaucuggcccaucaguucacacagguccagcgggacauguucacccuggaggacacgcugcuaggcuaccuugcugaugaccucacaugguguggugaauucaacacuuccaaaauaaacuaucaaucuugcccagacuggagaaaggacugcagcaacaacccuguuucaguauucuggaaaacgguuucccgcagguuugcagaagcugccugugaugugguccaugugaugcucaauggaucccgcaguaaaaucuuugacaaaaacagcacuuuugggaguguggaaguccauaauuugcaaccagagaagguucagacacuagaggccugggugauacaugguggaagagaagauuccagagacuuaugccaggaucccaccauaaaagagcuggaaucgauuauaagcaaaaggaauauucaauuuuccugcaagaauaucuacagaccugacaaguuucuucagugugugaaaaauccugaggauucaucuugcacaucugagaucugagccagucgcugugguuguuuuagcuccuugacuccuugugguuuaugucaucauacaugacucagcauaccugcuggugcagagcugaagauuuuggaggguccuccacaauaaggucaaugccagagacggaagccuuuuuccccaaagucuuaaaauaacuuauaucaucagcauaccuuuauugugaucuaucaauagucaagaaaaauuauuguauaagauuagaaugaaaauuguauguuaaguuacuucacuuuaauucucaugugauccuuuuauguuauuuauauauugguaacauccuuucuauugaaaaaucaccacaccaaaccucucuuauuagaacaggcaagugaagaaaagugaaugcucaaguuuuucagaaagcauuacauuuccaaaugaaugaccuuguugcaugauguauuuuuguacccuuccuacagauagucaaaccauaaacuucauggucauggguaaa

SEQ ID NO: 97 - RNA, 4454 nt, Homo_Sapiens
agcgcugagcugcaggcgcggcgaaacuucccucuacccgcccggcccgcggcgcgcaccguuggcgcuggacgcuuccuccuuggaagcgccucucccucaguuauggagaaaacuuguauagaugcacuuccucuuacuaugaauucuucagaaaagcaagagacuguauguauuuuuggaacuggugauuuuggaagaucacugggauugaaaaugcuccagugugguuauucuguuguuuuuggaagucgaaacccccagaagaccacccuacugcccaguggugcagaagucuugagcuauucagaagcagccaagaagucuggcaucauaaucauagcaauccacagagagcauuaugauuuucucacagaauuaacugagguucucaauggaaaaauauugguagacaucagcaacaaccucaaaaucaaucaauauccagaaucuaaugcagaguaccuugcucauuuggugccaggagcccacgugguaaaagcauuuaacaccaucucagccugggcucuccagucaggagcacuggaugcaagucggcagguguuuguguguggaaaugacagcaaagccaagcaaagagugauggauauuguucguaaucuuggacuuacuccaauggaucaaggaucacucauggcagccaaagaaauugaaaaguacccccugcagcuauuuccaauguggagguuccccuucuauuugucugcugugcugugugucuucuuguuuuucuauuguguuauaagagacguaaucuacccuuauguuuaugaaaagaaagauaauacauuucguauggcuauuuccauuccaaaucguaucuuuccaauaacagcacuuacacugcuugcuuugguuuaccucccugguguuauugcugccauucuacaacuguaccgaggcacaaaauaccgucgauucccagacuggcuugaccacuggaugcuuugccgaaagcagcuuggcuugguagcucugggauuugccuuccuucauguccucuacacacuugugauuccuauucgauauuauguacgauggagauugggaaacuuaaccguuacccaggcaauacucaagaaggagaauccauuuagcaccuccucagccuggcucagugauucauauguggcuuugggaauacuuggguuuuuucuguuuguacucuugggaaucacuucuuugccaucuguuagcaaugcagucaacuggagagaguuccgauuuguccaguccaaacuggguuauuugacccugaucuuguguacagcccacacccugguguacggugggaagagauuccucagcccuucaaaucucagaugguaucuuccugcagccuacguguuagggcuuaucauuccuugcacugugcuggugaucaaguuuguccuaaucaugccauguguagacaacacccuuacaaggauccgccagggcugggaaaggaacucaaaacacuagaaaaagcauugaauggaaaaucaauauuuaaaacaaaguucaauuuagcuggauuucugaacuaugguuuugaauguuuaaagaagaaugauggguacaguuaggaaaguuuuuuucuuacaccgugacugagggaaacauugcuugucuuugagaaauugacugacauacuggaagagaacaccauuuuaucucagguuagugaagaaucagugcaggucccugacucuuauuuucccagaggccauggagcugagauugagacuagccuugugguuucacacuaaagaguuuccuuguuaugggcaacaugcaugaccuaaugucuugcaaaauccaauagaaguauugcagcuuccuucucuggcucaagggcugaguuaagugaaaggaaaaacagcacaauggugaccacugauaaaggcuuuauuagguauaucugaggaagugggucacaugaaauguaaaaagggaaugagguuuuuguuguuuuuuggaaguaaaggcaaacauaaauauuaccaugaugaauucuagugaaaugaccccuugacuuugcuuuucuuaauacagauauuuacugagaggaacuauuuuuauaacacaagaaaaauuuacaauugauuaaaaguauccaugucuuggauacauacguaucuauagagcuggcauguaauucuuccucuauaaagaauagguauaggaaagacugaauaaaaauggagggauauccccuuggauuucacuugcauugugcaauaagcaaagaaggguugauaaaaguucuugaucaaaaaguucaaagaaaccagaauuuuagacagcaagcuaaauaaauauuguaaaauugcacuauauuagguuaaguauuauuuagguauuauaauaugcuuuguaaauuuuauauuccaaauauugcucaauauuuuucaucuauuaaauuaauuucuaguguaaauaaguagcuucuauaucugucuuagucuauuauaauuguaaggaguaaaauuaaaugaauagucugcagguauaaauuugaacaaugcauagaugaucgaaaauuacggaaaaucauagggcagagaggugugaagauucaucauuaugugaaauuuggaucuuucucaaauccuugcugaaauuuaggaugguucucacuguuuuucugugcugauaguacccuuuccaaggugaccuucagggggauuaaccuuccuagcucaagcaaugagcuaaaaggagccuuaugcaugaucuucccacauaucaaaauaacuaaaaggcacugaguuuggcauuuuucugccugcucugcuaagaccuuuuuuuuuuuuuacuuucauuauaacauauuauacaugacauuauacaaaaaugauuaaaauauauuaaaacaacaucaacaauccaggauauuuuucuauaaaacuuuuuaaaaauaauuguaucuauauauucaauuuuacauccuuuuucaaaggcuuuguuuuucuaaaggcuuuguuuuccuuuuuauuauuuuuuucuuuuuuauuuuuuugagacagucuugcucugucgcucaggcuggagugcaguggcacgaucucagcucacugcaaccuccuccucccagguucaagugauucuuguucaucagccucccgaguagcugggacuacaggcaugugccacuaugcccagcuaauuuuuguacuuuuaguagagacaggguuucaccacauuggucaggcuggucuugaaaugcuggcgucaagugaucugccugccuccgccucacaaagcacugggauuacaggcaugaaucuggccuuacguaauauauuuucuuaauggcugcauaauaucacaucaaauaggcauuuuucaaaccucuuuccuuauuaaacauguagacuauauccauuuuuuacuaaaauaaauaacauuucagauaauaucuuugcacugauaauguugccaagccauuucuaaagugaccuuaucaauuuaauuaccauuggaugaggguguugcuuucaucgcaccauuguagauugucuuuuuuauuucaauuugcguuuauuuauaacugguugcaaagguacacagaacacacgcuccuucaacuuaucuuugauaaacccaagcaaggauacaaaaaguuggacgacauugaguagagucaugguauacggugcugacccuacaguaucaguggaaaagauaaggaaaaugucacuacucaccuauguuaugcaaaacaguuaggugugcuggggcuggauacugcucuuuuacuugagcauugguugauuaaaguuuagguaccauccaggcuggucuagagaagucuuuggaguuaaccaugcucuuuuuguuaaagaagagaguaauguguuuauccuggcucauaguccgucaccgaaaauagaaaaugccauccauagguaaaaugcugaccuauagaaaaaaaugaacucuacuuuuauagccuaguaaaaaugcucuaccugaguaguuaaaagcaauucaugaagccugaagcuaaagagcacucugaugguuuuggcauaauagcugcauuuccagaccugaccuuuggccccaaccacaagugcuccaagccccaccagcugaccaaagaaagcccaaguucuccuucuguccuucccacaaccucccugcucccaaaacuaugaaauuaauuugaccauauuaacacagcugacuccuccaguuuacuuaagguagaaagaaugaguuuacaacagaugaaaauaagugcuuugggcgaacuguauuccuuuuaacagauccaaacuauuuuacauuuaaaaaaaaaguuaaacuaaacuucuuuacugcugauauguuuccuguauucuagaaaaauuuuuacacuuucacauuauuuuuguacacuuuccccauguuaagggaugauggcuuuuauaaauguguauucauuaaauguuacuuuaaaaaua

SEQ ID NO: 98 - RNA, 3150 nt, Homo_Sapiens
ccacaaagggcacuuggccccagggcuaggagagcgaggggagagcacagccacccgccucggcggcccgggacucggcucgacucgccggagaaugcgcccgaggacgacggggcgccagagccgcggugcuuucaacuggcgagcgcgaaugggggugcacuggaguaaggcagagugaugcgggggggcaacucgccuggcaccgagaucgccgccgugcccuucccuggacccggcgucgcccaggauggcugccccgagccaugggccgcggcggagcuagcgcggagcgcccgacccucgacccccgagucccggagccggccccgcgcggggccacgcgucccucgggcgcugguuccuaaggaggacgacagcaccagcuucuccuuucucccuucccuucccugccccgcacuccucccccugcucgcuguuguugugugucagcacuuggcuggggacuucuugaacuugcagggagaauaacuugcgcaccccacuuugcgccggugccuuugccccagcggagccugcuucgccaucuccgagccccaccgccccuccacuccucggccuugcccgacacugagacgcuguucccagcgugaaaagagagacugcgcggccggcacccgggagaaggaggaggcaaagaaaaggaacggacauucgguccuugcgccagguccuuugaccagaguuuuuccauguggacgcucuuucaauggacguguccccgcgugcuucuuagacggacugcggucuccuaaaggucgaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcaggugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuaguacagcaaaauuaaauacauaaauauauauauauauauauauuuuagaaaaaagaaaaaaacaaacaaacaaaaaaaccccaccccaguugacacuuuaauauuucccaaugaagacuuuauuuauggaauggaauggaaaaaaaaacagcuauuuugaaaauauauuuauaucuacgaaaagaaguugggaaaacaaauauuuuaaucagagaauuauuccuuaaagauuuaaaauguauuuaguuguacauuuuauauggguucaaccccagcacaugaaguauaauggucagauuuauuuuguauuuauuuacuauuauaaccacuuuuuaggaaaaaaauagcuaauuuguauuuauauguaaucaaaagaaguaucggguuuguacauaauuuuccaaaaauuguaguuguuuucaguuguguguauuuaagaugaaaagucuacauggaagguuacucuggcaaagugcuuagcacguuugcuuuuuugcagugcuacuguugaguucacaaguucaaguccagaaaaaaaaaguggauaauccacucugcugacuuucaagauuauuauauuauucaauucucaggaauguugcagagugauuguccaauccaugagaauuuacauccuuauuagguggaauauuuggauaagaaccagacauugcugaucuauuauagaaacucuccuccugccccuuaauuuacagaaagaauaaagcaggauccauagaaauaauuaggaaaacgaugaaccugcaggaaagugaaugaugguuuguuguucuucuuuccuaaauuagugaucccuucaaaggggcugaucuggccaaaguauucaauaaaacguaagauuucuucauuauugauauuguggucauauauauuuaaaauugauaucucguggcccucaucaaggguuggaaauuuauuuguguuuuaccuuuaccucaucugagagcucuuuauucuccaaagaacccaguuuucuaacuuuuugcccaacacgcagcaaaauuaugcacaucguguuuucugcccacccucuguucucugaccuaucagcuugcuuuucuuuccaagguuguguguuugaacacauuucuccaaauguuaaaccuauuucagauaauaaauaucaaaucucuggcauuucauucuauaaaguc

SEQ ID NO: 99 - RNA, 3130 nt, Homo_Sapiens
gagucaguggcuugaaacuuuuaaaagcucugugcuccaaguuacaaaaaagcuuuuacgagguaucagcacuuuucuuucauuagggggaaggcgugaggaaaguaccaaacagcagcggaguuuuaaacuuuaaauagacaggucugagugccugaacuugccuuuucauuuuacuucauccuccaaggaguucaaucacuuggcgugacuucacuacuuuuaagcaaaagaguggugcccaggcaacaugggugacuggagcgccuuaggcaaacuccuugacaagguucaagccuacucaacugcuggagggaagguguggcugucaguacuuuucauuuuccgaauccugcugcuggggacagcgguugagucagccuggggagaugagcagucugccuuucguuguaacacucagcaaccugguugugaaaaugucugcuaugacaagucuuucccaaucucucaugugcgcuucuggguccugcagaucauauuugugucuguacccacacucuuguaccuggcucauguguucuaugugaugcgaaaggaagagaaacugaacaagaaagaggaagaacucaagguugcccaaacugauggugucaauguggacaugcacuugaagcagauugagauaaagaaguucaaguacgguauugaagagcaugguaaggugaaaaugcgagggggguugcugcgaaccuacaucaucaguauccucuucaagucuaucuuugagguggccuucuugcugauccagugguacaucuauggauucagcuugagugcuguuuacacuugcaaaagagaucccugcccacaucagguggacuguuuccucucucgccccacggagaaaaccaucuucaucaucuucaugcuggugguguccuuggugucccuggccuugaauaucauugaacucuucuauguuuucuucaagggcguuaaggaucggguuaagggaaagagcgacccuuaccaugcgaccaguggugcgcugagcccugccaaagacugugggucucaaaaauaugcuuauuucaauggcugcuccucaccaaccgcuccccucucgccuaugucuccuccuggguacaagcugguuacuggcgacagaaacaauucuucuugccgcaauuacaacaagcaagcaagugagcaaaacugggcuaauuacagugcagaacaaaaucgaauggggcaggcgggaagcaccaucucuaacucccaugcacagccuuuugauuuccccgaugauaaccagaauucuaaaaaacuagcugcuggacaugaauuacagccacuagccauuguggaccagcgaccuucaagcagagccagcagucgugccagcagcagaccucggccugaugaccuggagaucuagauacaggcuugaaagcaucaagauuccacucaauuguggagaagaaaaaaggugcuguagaaagugcaccagguguuaauuuugauccgguggaggugguacucaacagccuuauucaugaggcuuagaaaacacaaagacauuagaauaccuagguucacuggggguguaugggguagauggguggagagggaggggauaagagaggugcauguugguauuuaaaguaguggauucaaagaacuuagauuauaaauaagaguuccauuaggugauacauagauaagggcuuuuucuccccgcaaacaccccuaagaaugguucuguguaugugaaugagcgggugguaauuguggcuaaauauuuuuguuuuaccaagaaacugaaauaauucuggccaggaauaaauacuuccugaacaucuuaggucuuuucaacaagaaaaagacagaggauuguccuuaagucccugcuaaaacauuccauuguuaaaauuugcacuuugaagguaagcuuucuaggccugacccuccaggugucaauggacuugugcuacuauauuuuuuuauucuugguaucaguuuaaaauucagacaaggcccacagaauaagauuuuccaugcauuugcaaauacguauauucuuuuuccauccacuugcacaauaucauuaccaucacuuuuucaucauuccucagcuacuacucacauucauuuaaugguuucuguaaacauuuuuaagacaguugggaugucacuuaacauuuuuuuuuugagcuaaagucagggaaucaagccaugcuuaauauuuaacaaucacuuauaugugugucgaagaguuuguuuuguuugucauguauugguacaagcagauacaguauaaacucacaaacacagauuugaaaauaaugcacauaugguguucaaauuugaaccuuucucauggauuuuuguggugugggccaauaugguguuuacauuauauaauuccugcuguggcaaguaaagcacacuuuuuuuuucuccuaaaauguuuuucccuguguauccuauuauggauacugguuuuguuaauuaugauucuuuauuuucucuccuuuuuuuaggauauagcaguaaugcuauuacugaaaugaauuuccuuuuucugaaauguaaucauugaugcuugaaugauagaauuuuaguacuguaaacaggcuuuagucauuaaugugagagacuuagaaaaaaugcuuagaguggacuauuaaaugugccuaaaugaauuuugcaguaacugguauucuuggguuuuccuacuuaauacacaguaauucagaacuuguauucuauuaugaguuuagcagucuuuuggagugaccagcaacuuugauguuugcacuaagauuuuauuuggaaugcaagagagguugaaagaggauucaguaguacacauacaacuaauuuauuugaacuauauguugaagacaucuaccaguuucuccaaaugccuuuuuuaaaacucaucacagaagauuggugaaaaugcugaguaugacacuuuucuucuugcaugcaugucagcuacauaaacaguuuuguacaaugaaaauuacuaauuuguuugacauuccauguuaaacuacggucauguucagcuucauugcauguaauguagaccuaguccaucagaucauguguucuggagaguguucuuuauucaauaaaguuuuaauuuaguauaaacaua

SEQ ID NO: 100 - RNA, 608 nt, Homo_Sapiens
agacuuccuccuucacuugccuggacgcugcgccacaucccaccggcccuuacacugugguguccagcagcauccggcuucauggggggacuugaacccugcagcaggcuccugcuccugccucuccugcuggcuguaaguggucuccguccuguccaggcccaggcccagagcgauugcaguugcucuacggugagcccgggcgugcuggcagggaucgugaugggagaccuggugcugacagugcucauugcccuggccguguacuuccugggccggcuggucccucgggggcgaggggcugcggaggcagcgacccggaaacagcguaucacugagaccgagucgccuuaucaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacaaaaaaaaaaaaaaaaaa

SEQ ID NO: 101 - RNA, 605 nt, Homo_Sapiens
agacuuccuccuucacuugccuggacgcugcgccacaucccaccggcccuuacacugugguguccagcagcauccggcuucauggggggacuugaacccugcagcaggcuccugcuccugccucuccugcuggcuguaaguggucuccguccuguccaggcccaggcccagagcgauugcaguugcucuacggugagcccgggcgugcuggcagggaucgugaugggagaccuggugcugacagugcucauugcccuggccguguacuuccugggccggcuggucccucgggggcgaggggcugcggaggcgacccggaaacagcguaucacugagaccgagucgccuuaucaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacaaaaaaaaaaaaaaaaaa

SEQ ID NO: 102 - RNA, 575 nt, Homo_Sapiens
agacuuccuccuucacuugccuggacgcugcgccacaucccaccggcccuuacacugugguguccagcagcauccggcuucauggggggacuugaacccugcagcaggcuccugcuccugccucuccugcuggcuguaagugauugcaguugcucuacggugagcccgggcgugcuggcagggaucgugaugggagaccuggugcugacagugcucauugcccuggccguguacuuccugggccggcuggucccucgggggcgaggggcugcggaggcagcgacccggaaacagcguaucacugagaccgagucgccuuaucaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacaaaaaaaaaaaaaaaaaa

SEQ ID NO: 103 - RNA, 572 nt, Homo_Sapiens
agacuuccuccuucacuugccuggacgcugcgccacaucccaccggcccuuacacugugguguccagcagcauccggcuucauggggggacuugaacccugcagcaggcuccugcuccugccucuccugcuggcuguaagugauugcaguugcucuacggugagcccgggcgugcuggcagggaucgugaugggagaccuggugcugacagugcucauugcccuggccguguacuuccugggccggcuggucccucgggggcgaggggcugcggaggcgacccggaaacagcguaucacugagaccgagucgccuuaucaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacaaaaaaaaaaaaaaaaaa

SEQ ID NO: 104 - RNA, 568 nt, Homo_Sapiens
agacuuccuccuucacuugccuggacgcugcgccacaucccaccggcccuuacacugugguguccagcagcauccggcuucauggggggacuugaacccugcagcaggcuccugcuccugccucuccugcuggcuauugcaguugcucuacggugagcccgggcgugcuggcagggaucgugaugggagaccuggugcugacagugcucauugcccuggccguguacuuccugggccggcuggucccucgggggcgaggggcugcggaggcagcgacccggaaacagcguaucacugagaccgagucgccuuaucaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacaaaaaaaaaaaaaaaaaa

SEQ ID NO: 105 - RNA, 2358 nt, Homo_Sapiens
aaacucacacaacaacucuuccccgcugagaggagacagccagugcgacuccacccuccagcucgacggcagccgccccggccgacagccccgagacgacagcccggcgcgucccgguccccaccuccgaccaccgccagcgcuccaggccccgccgcuccccgcucgccgccaccgcgcccuccgcuccgcccgcagugccaaccaugaccgccgccaguaugggccccguccgcgucgccuucgugguccuccucgcccucugcagccggccggccgucggccagaacugcagcgggccgugccggugcccggacgagccggcgccgcgcugcccggcgggcgugagccucgugcuggacggcugcggcugcugccgcgucugcgccaagcagcugggcgagcugugcaccgagcgcgaccccugcgacccgcacaagggccucuucugugacuucggcuccccggccaaccgcaagaucggcgugugcaccgccaaagauggugcucccugcaucuucggugguacgguguaccgcagcggagaguccuuccagagcagcugcaaguaccagugcacgugccuggacggggcggugggcugcaugccccugugcagcauggacguucgucugcccagcccugacugccccuucccgaggagggucaagcugcccgggaaaugcugcgaggagugggugugugacgagcccaaggaccaaaccgugguugggccugcccucgcggcuuaccgacuggaagacacguuuggcccagacccaacuaugauuagagccaacugccugguccagaccacagaguggagcgccuguuccaagaccugugggaugggcaucuccacccggguuaccaaugacaacgccuccugcaggcuagagaagcagagccgccugugcauggucaggccuugcgaagcugaccuggaagagaacauuaagaagggcaaaaagugcauccguacucccaaaaucuccaagccuaucaaguuugagcuuucuggcugcaccagcaugaagacauaccgagcuaaauucuguggaguauguaccgacggccgaugcugcaccccccacagaaccaccacccugccgguggaguucaagugcccugacggcgaggucaugaagaagaacaugauguucaucaagaccugugccugccauuacaacugucccggagacaaugacaucuuugaaucgcuguacuacaggaagauguacggagacauggcaugaagccagagagugagagacauuaacucauuagacuggaacuugaacugauucacaucucauuuuuccguaaaaaugauuucaguagcacaaguuauuuaaaucuguuuuucuaacugggggaaaagauucccacccaauucaaaacauugugccaugucaaacaaauagucuaucaaccccagacacugguuugaagaauguuaagacuugacaguggaacuacauuaguacacagcaccagaauguauauuaagguguggcuuuaggagcagugggaggguaccagcagaaagguuaguaucaucagauagcaucuuauacgaguaauaugccugcuauuugaaguguaauugagaaggaaaauuuuagcgugcucacugaccugccuguagccccagugacagcuaggaugugcauucuccagccaucaagagacugagucaaguuguuccuuaagucagaacagcagacucagcucugacauucugauucgaaugacacuguucaggaaucggaauccugucgauuagacuggacagcuuguggcaagugaauuugccuguaacaagccagauuuuuuaaaauuuauauuguaaauauuguguguguguguguguguguauauauauauauauguacaguuaucuaaguuaauuuaaaguuguuugugccuuuuuauuuuuguuuuuaaugcuuugauauuucaauguuagccucaauuucugaacaccauagguagaauguaaagcuugucugaucguucaaagcaugaaauggauacuuauauggaaauucugcucagauagaaugacaguccgucaaaacagauuguuugcaaaggggaggcaucaguguccuuggcaggcugauuucuagguaggaaaugugguagccucacuuuuaaugaacaaauggccuuuauuaaaaacugagugacucuauauagcugaucaguuuuuucaccuggaagcauuuguuucuacuuugauaugacuguuuuucggacaguuuauuuguugagagugugaccaaaaguuacauguuugcaccuuucuaguugaaaauaaaguguauauuuuuucuauaaaaaaaaaaaaaaaaa

SEQ ID NO: 106 - RNA, 1632 nt, Homo_Sapiens
gcucagcauuuggggacgcucucagcucucggcgcacggcccagguaagcggggcgcgcccugcccgcccgcgaugggccgccagcuagcgggguguggagacgcugggaagaaggcuuccuucaaaaugucuacuguucacgaaauccugugcaagcucagcuuggagggugaucacucuacacccccaagugcauaugggucugucaaagccuauacuaacuuugaugcugagcgggaugcuuugaacauugaaacagccaucaagaccaaagguguggaugaggucaccauugucaacauuuugaccaaccgcagcaaugcacagagacaggauauugccuucgccuaccagagaaggaccaaaaaggaacuugcaucagcacugaagucagccuuaucuggccaccuggagacggugauuuugggccuauugaagacaccugcucaguaugacgcuucugagcuaaaagcuuccaugaaggggcugggaaccgacgaggacucucucauugagaucaucugcuccagaaccaaccaggagcugcaggaaauuaacagagucuacaaggaaauguacaagacugaucuggagaaggacauuauuucggacacaucuggugacuuccgcaagcugaugguugcccuggcaaaggguagaagagcagaggauggcucugucauugauuaugaacugauugaccaagaugcucgggaucucuaugacgcuggagugaagaggaaaggaacugauguucccaaguggaucagcaucaugaccgagcggagcgugccccaccuccagaaaguauuugauagguacaagaguuacagcccuuaugacauguuggaaagcaucaggaaagagguuaaaggagaccuggaaaaugcuuuccugaaccugguucagugcauucagaacaagccccuguauuuugcugaucggcuguaugacuccaugaagggcaaggggacgcgagauaagguccugaucagaaucauggucucccgcagugaaguggacauguugaaaauuaggucugaauucaagagaaaguacggcaagucccuguacuauuauauccagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuuagaaacacguacuuuguggcccugcuuucaacugaauuguuugaaaauuaaacgugcuugggguucagcuggugaggcugucccuguaggaagaaagcucugggacugagcuguacaguaugguugccccuauccaagugucgcuauuuaaguuaaauuuaaaugaaauaaaauaaaauaaaaucaaaaaaa

SEQ ID NO: 107 - RNA, 1644 nt, Homo_Sapiens
gcucagcauuuggggacgcucucagcucucggcgcacggcccagguuaucuuguagcauagcaacuucggauuucacucuacccggagaguuucccgcuugguugaacacauuggccucaggaagcuuccuucaaaaugucuacuguucacgaaauccugugcaagcucagcuuggagggugaucacucuacacccccaagugcauaugggucugucaaagccuauacuaacuuugaugcugagcgggaugcuuugaacauugaaacagccaucaagaccaaagguguggaugaggucaccauugucaacauuuugaccaaccgcagcaaugcacagagacaggauauugccuucgccuaccagagaaggaccaaaaaggaacuugcaucagcacugaagucagccuuaucuggccaccuggagacggugauuuugggccuauugaagacaccugcucaguaugacgcuucugagcuaaaagcuuccaugaaggggcugggaaccgacgaggacucucucauugagaucaucugcuccagaaccaaccaggagcugcaggaaauuaacagagucuacaaggaaauguacaagacugaucuggagaaggacauuauuucggacacaucuggugacuuccgcaagcugaugguugcccuggcaaaggguagaagagcagaggauggcucugucauugauuaugaacugauugaccaagaugcucgggaucucuaugacgcuggagugaagaggaaaggaacugauguucccaaguggaucagcaucaugaccgagcggagcgugccccaccuccagaaaguauuugauagguacaagaguuacagcccuuaugacauguuggaaagcaucaggaaagagguuaaaggagaccuggaaaaugcuuuccugaaccugguucagugcauucagaacaagccccuguauuuugcugaucggcuguaugacuccaugaagggcaaggggacgcgagauaagguccugaucagaaucauggucucccgcagugaaguggacauguugaaaauuaggucugaauucaagagaaaguacggcaagucccuguacuauuauauccagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuuagaaacacguacuuuguggcccugcuuucaacugaauuguuugaaaauuaaacgugcuugggguucagcuggugaggcugucccuguaggaagaaagcucugggacugagcuguacaguaugguugccccuauccaagugucgcuauuuaaguuaaauuuaaaugaaauaaaauaaaauaaaaucaaaaaaaaaa

SEQ ID NO: 108 - RNA, 1563 nt, Homo_Sapiens
gcucagcauuuggggacgcucucagcucucggcgcacggcccagcuuccuucaaaaugucuacuguucacgaaauccugugcaagcucagcuuggagggugaucacucuacacccccaagugcauaugggucugucaaagccuauacuaacuuugaugcugagcgggaugcuuugaacauugaaacagccaucaagaccaaagguguggaugaggucaccauugucaacauuuugaccaaccgcagcaaugcacagagacaggauauugccuucgccuaccagagaaggaccaaaaaggaacuugcaucagcacugaagucagccuuaucuggccaccuggagacggugauuuugggccuauugaagacaccugcucaguaugacgcuucugagcuaaaagcuuccaugaaggggcugggaaccgacgaggacucucucauugagaucaucugcuccagaaccaaccaggagcugcaggaaauuaacagagucuacaaggaaauguacaagacugaucuggagaaggacauuauuucggacacaucuggugacuuccgcaagcugaugguugcccuggcaaaggguagaagagcagaggauggcucugucauugauuaugaacugauugaccaagaugcucgggaucucuaugacgcuggagugaagaggaaaggaacugauguucccaaguggaucagcaucaugaccgagcggagcgugccccaccuccagaaaguauuugauagguacaagaguuacagcccuuaugacauguuggaaagcaucaggaaagagguuaaaggagaccuggaaaaugcuuuccugaaccugguucagugcauucagaacaagccccuguauuuugcugaucggcuguaugacuccaugaagggcaaggggacgcgagauaagguccugaucagaaucauggucucccgcagugaaguggacauguugaaaauuaggucugaauucaagagaaaguacggcaagucccuguacuauuauauccagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuuagaaacacguacuuuguggcccugcuuucaacugaauuguuugaaaauuaaacgugcuugggguucagcuggugaggcugucccuguaggaagaaagcucugggacugagcuguacaguaugguugccccuauccaagugucgcuauuuaaguuaaauuuaaaugaaauaaaauaaaauaaaaucaaaaaaaaaa

SEQ ID NO: 109 - RNA, 1665 nt, Homo_Sapiens
gcucagcauuuggggacgcucucagcucucggcgcacggcccagggugaaaauguuugccauuaaacucacaugaaguaggaaauauuuauauggauacaaaaggcaccugcaugggauaaugucaaauuucauagauacugcuuugugcuuccuucaaaaugucuacuguucacgaaauccugugcaagcucagcuuggagggugaucacucuacacccccaagugcauaugggucugucaaagccuauacuaacuuugaugcugagcgggaugcuuugaacauugaaacagccaucaagaccaaagguguggaugaggucaccauugucaacauuuugaccaaccgcagcaaugcacagagacaggauauugccuucgccuaccagagaaggaccaaaaaggaacuugcaucagcacugaagucagccuuaucuggccaccuggagacggugauuuugggccuauugaagacaccugcucaguaugacgcuucugagcuaaaagcuuccaugaaggggcugggaaccgacgaggacucucucauugagaucaucugcuccagaaccaaccaggagcugcaggaaauuaacagagucuacaaggaaauguacaagacugaucuggagaaggacauuauuucggacacaucuggugacuuccgcaagcugaugguugcccuggcaaaggguagaagagcagaggauggcucugucauugauuaugaacugauugaccaagaugcucgggaucucuaugacgcuggagugaagaggaaaggaacugauguucccaaguggaucagcaucaugaccgagcggagcgugccccaccuccagaaaguauuugauagguacaagaguuacagcccuuaugacauguuggaaagcaucaggaaagagguuaaaggagaccuggaaaaugcuuuccugaaccugguucagugcauucagaacaagccccuguauuuugcugaucggcuguaugacuccaugaagggcaaggggacgcgagauaagguccugaucagaaucauggucucccgcagugaaguggacauguugaaaauuaggucugaauucaagagaaaguacggcaagucccuguacuauuauauccagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuuagaaacacguacuuuguggcccugcuuucaacugaauuguuugaaaauuaaacgugcuugggguucagcuggugaggcugucccuguaggaagaaagcucugggacugagcuguacaguaugguugccccuauccaagugucgcuauuuaaguuaaauuuaaaugaaauaaaauaaaauaaaaucaaaaaaa

SEQ ID NO: 110 - RNA, 1926 nt, Homo_Sapiens
guggaugagcugugagugcgcgcgcgugcgcggggccgcgaccugugccggcucgagcccgcugggcacucggaggcgcgcacgucguuccccgcccucccgccgccgcccgcccucgcucucucgcgcuacccucccgccgcccgcgguccuccgucgguucucucguuaguccacggucuggucuucagcuacccgccuucgucuccgaguuugcgacucgcggaccggcguccccggcgcgaagaggcuggacucggauucguugccugagcaauggcugccauccggaagaaacuggugauuguuggugauggagccuguggaaagacaugcuugcucauagucuucagcaaggaccaguucccagagguguaugugcccacaguguuugagaacuauguggcagauaucgagguggauggaaagcagguagaguuggcuuugugggacacagcugggcaggaagauuaugaucgccugaggccccucuccuacccagauaccgauguuauacugauguguuuuuccaucgacagcccugauaguuuagaaaacaucccagaaaaguggaccccagaagucaagcauuucugucccaacgugcccaucauccugguugggaauaagaaggaucuucggaaugaugagcacacaaggcgggagcuagccaagaugaagcaggagccggugaaaccugaagaaggcagagauauggcaaacaggauuggcgcuuuuggguacauggaguguucagcaaagaccaaagauggagugagagagguuuuugaaauggcuacgagagcugcucugcaagcuagacgugggaagaaaaaaucugggugccuugucuugugaaaccuugcugcaagcacagcccuuaugcgguuaauuuugaagugcuguuuauuaaucuuaguguaugauuacuggccuuuuucauuuaucuauaauuuaccuaagauuacaaaucagaagucaucuugcuaccaguauuuagaagccaacuaugauuauuaacgauguccaacccgucuggcccaccaggguccuuuugacacugcucuaacagcccuccucugcacucccaccugacacaccaggcgcuaauucaaggaauuucuuaacuucuugcuucuuucuagaaagagaaacaguugguaacuuuugugaauuaggcuguaacuacuuuauaacuaacauguccugccuauuaucugucagcugcaagguacucuggugagucaccacuucagggcuuuacuccguaacagauuuuguuggcauagcucuggggugggcaguuuuuugaaaaugggcucaaccagaaaagcccaaguucaugcagcuguggcagaguuacaguucugugguuucauguuaguuaccuuauaguuacuguguaauuagugccacuuaauguauguuaccaaaaauaaauauaucuaccccagacuagauguaguauuuuuuguauaauuggauuuccuaauacugucauccucaaagaaaguguauugguuuuuuaaaaaagaaaguguauuuggaaauaaagucagauggaaaauucauuuuuuaaauucccguuuugucacuuuuucugauaaaagauggccauauuaccccuuuucggccccauguaucucaguaccccauggagcugggcuaaguaaauaggaauugguuucacgccugaggcaauuagacacuuuggaagauggcauaaccugucucaccuggacuuaagcaucuggcucuaauucacagugcucuuuucuccucacuguauccagguucccucccagaggagccaccaguucucauggguggcacucagucucucuucucuccagcugacuaaacuuuuuuucuguaccaguuaauuuuuccaacuacuaauagaauaaaggcaguuuucuaaaaaaa

SEQ ID NO: 111 - RNA, 5693 nt, Homo_Sapiens
gcagagcugcagaggcaccggacgagagagggcuccgcgggcccagcuggcagccaggccggagacaaguugcagucccgggcucuggugacgccguggccgcagcuggaagaggaaaacaaggaucagauuggagaagugauuuaucuaagaucccacaguggacuggcagcagcacugagaccucagccuagucuccugauccccaagcagggcccugccuaaggaacacacucugcagagugcugggccaaagcaggguuuuccaacuaaucuuagaagguaaaguccaugaagggucuccauuuugggacauucuaaucccugagccccuauuauuuucaucaugggcuucugccuggcucuagcauggacacuucugguuggggcauggaccccucugggagcucagaaccccauuucgugggaggugcagcgauuugaugggugguacaacaaccucauggagcacagauggggcagcaaaggcucccggcugcagcgccuggucccagccagcuaugcagauggcguguaccagcccuugggagaaccccaccugcccaacccccgagaccuuagcaacaccaucucaaggggcccugcagggcuggccucccugagaaaccgcacaguguugggggucuucuuuggcuaucacgugcuuucagaccuggugagcguggaaacucccggcugccccgccgaguuccucaacauucgcaucccgcccggagaccccauguucgaccccgaccagcgcggggacguggugcugcccuuccagagaagccgcugggaccccgagaccggacggagucccagcaauccccgggacccggccaaccaggugacgggcuggcuggacggcagcgccaucuaugguuccucgcauuccuggagcgacgcgcugcggagcuucuccaggggacagcuggcgucggggcccgaccccgcuuuuccccgagacucgcagaacccccugcucaugugggcggcgcccgaccccgccaccgggcagaacgggccccgggggcuguacgccuucggggcagagagagggaaccgggaacccuuccugcaggcgcugggccugcucugguuccgcuaccacaaccugugggcgcagaggcuggcccgccagcacccagacugggaggacgaggagcuguuccagcacgcacgcaagagggucaucgccaccuaccagaacaucgcuguguaugaguggcugcccagcuuccugcagaaaacacucccggaguauacaggauaccggccauuucuggaccccagcaucuccucagaguucguggcggccucugagcaguuccuguccaccauggugcccccuggcgucuacaugagaaaugccagcugccacuuccagggggucaucaaucggaacucaagugucuccagagcucuccgggucugcaacagcuacuggagccgugagcacccaagccuacaaagugcugaagauguggaugcacugcugcugggcauggccucccagaucgcagagcgagaggaccauguguugguugaagaugugcgggauuucuggccugggccacugaaguuuucccgcacagaccaccuggccagcugccugcagcggggccgggaucugggccugcccucuuacaccaaggccagggcagcacugggcuugucucccauuacccgcuggcaggacaucaacccugcacucucccggagcaaugacacuguacuggaggccacagcugcccuguacaaccaggacuuauccuggcuagagcugcucccugggggacuccuggagagccaccgggacccuggaccucuguucagcaccaucguccuugaacaauuugugcggcuacgggauggugaccgcuacugguuugagaacaccaggaaugggcuguucuccaagaaggagauugaagaaauccgaaauaccacccugcaggacgugcuggucgcuguuaucaacauugaccccagugcucugcagcccaaugucuuugucuggcauaaaggagaccccuguccgcagccgagacagcucagcacugaaggccugccagcgugugcucccucuguuguucgugacuauuuugagggcaguggauuuggcuucggggucaccaucgggacccucuguugcuucccuuuggugagccugcucagugccuggauuguugcccggcuccggaugagaaauuucaagaggcuccagggccaggaccgccagagcaucgugucugagaagcucgugggaggcauggaagcuuuggaauggcaaggccacaaggagcccugccggcccgugcuuguguaccugcagcccgggcagauccgugugguagauggcaggcucaccgugcuccgcaccauccagcugcagccuccacagaaggucaacuucguccuguccagcaaccguggacgccgcacucugcugcucaagauccccaaggaguaugaccuggugcugcuguuuaacuuggaggaagagcggcaggcgcugguggaaaaucuccggggagcucugaaggagagcggguugagcauccaggagugggagcugcgggagcaggagcugaugagagcagcugugacacgggagcagcggaggcaccuccuggagaccuuuuucaggcaccuuuucucccaggugcuggacaucaaccaggccgacgcagggacccugccccuggacuccucccagaaggugcgggaggcccugaccugugagcugagcagggccgaguuugccgagucccugggccucaagccccaggacauguuuguggaguccauguucucucuggcugacaaggauggcaauggcuaccuguccuuccgagaguuccuggacauccugguggucuucaugaaaggcucuccugaggaaaagucucgccuuauguuccgcauguacgacuuugaugggaauggccucauuuccaaggaugaguucaucaggaugcugagauccuucaucgagaucuccaacaacugccuguccaaggcccagcuggcugaggugguggaguccauguuccgggagucgggauuccaggacaaggaggaacugacaugggaagauuuucacuucaugcugcgggaccacaauagcgagcuccgcuucacgcagcucugugucaaagggguggaggugccugaagucaucaaggaccucugccggcgagccuccuacaucagccaggauaugaucugucccucucccagagugagugcccgcuguucccgcagcgacauugagacugaguugacaccucagagacugcagugccccauggacacagacccuccccaggagauucggcggagguuuggcaagaagguaacgucauuccagcccuugcuguucacugaggcgcaccgagagaaguuccaacgcagcugucuccaccagacggugcaacaguucaagcgcuucauugagaacuaccggcgccacaucggcugcguggccguguucuacgccaucgcuggggggcuuuuccuggagagggccuacuacuacgccuuugccgcacaucacacgggcaucacagacaccacccgcgugggaaucauccugucgcggggcacagcagccagcaucucuuucauguucuccuacaucuugcucaccaugugccgcaaccucaucaccuuccugcgagaaaccuuccucaaccgcuacgugcccuucgacgccgccguggacuuccaucgccucauugccuccaccgccaucguccucacagucuuacacagugugggccauguggugaauguguaccuguucuccaucagcccccucagcguccucucuugccucuuuccuggccucuuccaugaugaugggucugagcucccccagaaguauuacuggugguucuuccagaccguaccaggccucacggggguugugcugcuccugauccuggccaucauguaugucuuugccucccaccacuuccgccgccgcaguuuccggggcuucuggcugacccaccaccucuacauccugcucuauguccugcucaucauccaugguagcuuugcccugauccagcugccccguuuccacaucuucuuccuggucccagcaaucaucuaugggggcgacaagcuggugagccugagccggaagaagguggagaucagcguggugaaggcggagcugcugcccucaggagugacccaccugcgguuccagcggccccagggcuuugaguacaagucagggcagugggugcggaucgcuugccuggcucuggggaccaccgaguaccaccccuucacacugaccucugcgccccaugaggacacgcuuagccugcacauccgggcagcagggcccuggaccacucgccucagggagaucuacucagccccgacgggugacagaugugccagauacccaaagcuguaccuugauggaccauuuggagagggccaccaggaguggcauaaguuugaggugucaguguuagugggagggggcauuggggucaccccuuuugccuccauccucaaagaccuggucuucaagucauccgucagcugccaaguguucuguaagaagaucuacuucaucugggugacgcggacccagcgucaguuugaguggcuggcugacaucauccgagagguggaggagaaugaccaccaggaccuggugucugugcacaucuacaucacccagcuggcugagaaguucgaccucaggaccacuaugcuguacaucugugagcggcacuuccagaagguucugaaccggagucuauucacaggccugcgcuccaucacccacuuuggccguccccccuuugagcccuucuucaacucccugcaggagguccacccccagguccggaagaucgggguguuuagcuguggccccccuggcaugaccaagaauguggaaaaggccugucagcucaucaacaggcaggaccggacucacuucucccaccauuaugagaacuucuaggccccugcccggggguucugcccacugcccaguugagcagagguuugagcccacaccucaccucuguucuuccuauuucuggcugccucagccuucucugauuucccaccucccaaccuuguuccagguggccauagucagucaccaugugugggcucagggacccccaggaccaggaugugucucagccuggagaaauggugggggggcagugucuagggacuagagugagaaguaggggagcuacugauuuggggcaaagugaaaccucugcuuccagacuucagaaacaaaucucagaagacaagcugaccugacaaguacuaugugugugcaugucuguauguguguuggggcggugaguguaaggaugcagugggagcauggaugcuggcaucuuagaacccucccuacucccauaccuccuccucuucugggcuccccacugucagacgggcuggcaaaugccuugcaggagguagaggcuggacccauggcaagccauuuacagaaacccacucggcaccccagucuaacaccacaacuaauuucacccaagguuuuaagcacguucuuucaucagacccuggcccaauaccuauguaugcaaugcuccucagcccucuucucccugcuccaguagucucccuuccaaauaaaucacuuuucugccuuaaaaaaaaaaaaaaaa

SEQ ID NO: 112 - RNA, 5501 nt, Homo_Sapiens
gcagagcugcagaggcaccggacgagagagggcuccgcgggcccagcuggcagccaggccggagacaaguugcagucccgggcucuggugacgccguggccgcagggucuccauuuugggacauucuaaucccugagccccuauuauuuucaucaugggcuucugccuggcucuagcauggacacuucugguuggggcauggaccccucugggagcucagaaccccauuucgugggaggugcagcgauuugaugggugguacaacaaccucauggagcacagauggggcagcaaaggcucccggcugcagcgccuggucccagccagcuaugcagauggcguguaccagcccuugggagaaccccaccugcccaacccccgagaccuuagcaacaccaucucaaggggcccugcagggcuggccucccugagaaaccgcacaguguugggggucuucuuuggcuaucacgugcuuucagaccuggugagcguggaaacucccggcugccccgccgaguuccucaacauucgcaucccgcccggagaccccauguucgaccccgaccagcgcggggacguggugcugcccuuccagagaagccgcugggaccccgagaccggacggagucccagcaauccccgggacccggccaaccaggugacgggcuggcuggacggcagcgccaucuaugguuccucgcauuccuggagcgacgcgcugcggagcuucuccaggggacagcuggcgucggggcccgaccccgcuuuuccccgagacucgcagaacccccugcucaugugggcggcgcccgaccccgccaccgggcagaacgggccccgggggcuguacgccuucggggcagagagagggaaccgggaacccuuccugcaggcgcugggccugcucugguuccgcuaccacaaccugugggcgcagaggcuggcccgccagcacccagacugggaggacgaggagcuguuccagcacgcacgcaagagggucaucgccaccuaccagaacaucgcuguguaugaguggcugcccagcuuccugcagaaaacacucccggaguauacaggauaccggccauuucuggaccccagcaucuccucagaguucguggcggccucugagcaguuccuguccaccauggugcccccuggcgucuacaugagaaaugccagcugccacuuccagggggucaucaaucggaacucaagugucuccagagcucuccgggucugcaacagcuacuggagccgugagcacccaagccuacaaagugcugaagauguggaugcacugcugcugggcauggccucccagaucgcagagcgagaggaccauguguugguugaagaugugcgggauuucuggccugggccacugaaguuuucccgcacagaccaccuggccagcugccugcagcggggccgggaucugggccugcccucuuacaccaaggccagggcagcacugggcuugucucccauuacccgcuggcaggacaucaacccugcacucucccggagcaaugacacuguacuggaggccacagcugcccuguacaaccaggacuuauccuggcuagagcugcucccugggggacuccuggagagccaccgggacccuggaccucuguucagcaccaucguccuugaacaauuugugcggcuacgggauggugaccgcuacugguuugagaacaccaggaaugggcuguucuccaagaaggagauugaagaaauccgaaauaccacccugcaggacgugcuggucgcuguuaucaacauugaccccagugcucugcagcccaaugucuuugucuggcauaaaggagaccccuguccgcagccgagacagcucagcacugaaggccugccagcgugugcucccucuguuguucgugacuauuuugagggcaguggauuuggcuucggggucaccaucgggacccucuguugcuucccuuuggugagccugcucagugccuggauuguugcccggcuccggaugagaaauuucaagaggcuccagggccaggaccgccagagcaucgugucugagaagcucgugggaggcauggaagcuuuggaauggcaaggccacaaggagcccugccggcccgugcuuguguaccugcagcccgggcagauccgugugguagauggcaggcucaccgugcuccgcaccauccagcugcagccuccacagaaggucaacuucguccuguccagcaaccguggacgccgcacucugcugcucaagauccccaaggaguaugaccuggugcugcuguuuaacuuggaggaagagcggcaggcgcugguggaaaaucuccggggagcucugaaggagagcggguugagcauccaggagugggagcugcgggagcaggagcugaugagagcagcugugacacgggagcagcggaggcaccuccuggagaccuuuuucaggcaccuuuucucccaggugcuggacaucaaccaggccgacgcagggacccugccccuggacuccucccagaaggugcgggaggcccugaccugugagcugagcagggccgaguuugccgagucccugggccucaagccccaggacauguuuguggaguccauguucucucuggcugacaaggauggcaauggcuaccuguccuuccgagaguuccuggacauccugguggucuucaugaaaggcucuccugaggaaaagucucgccuuauguuccgcauguacgacuuugaugggaauggccucauuuccaaggaugaguucaucaggaugcugagauccuucaucgagaucuccaacaacugccuguccaaggcccagcuggcugaggugguggaguccauguuccgggagucgggauuccaggacaaggaggaacugacaugggaagauuuucacuucaugcugcgggaccacaauagcgagcuccgcuucacgcagcucugugucaaagggguggaggugccugaagucaucaaggaccucugccggcgagccuccuacaucagccaggauaugaucugucccucucccagagugagugcccgcuguucccgcagcgacauugagacugaguugacaccucagagacugcagugccccauggacacagacccuccccaggagauucggcggagguuuggcaagaagguaacgucauuccagcccuugcuguucacugaggcgcaccgagagaaguuccaacgcagcugucuccaccagacggugcaacaguucaagcgcuucauugagaacuaccggcgccacaucggcugcguggccguguucuacgccaucgcuggggggcuuuuccuggagagggccuacuacuacgccuuugccgcacaucacacgggcaucacagacaccacccgcgugggaaucauccugucgcggggcacagcagccagcaucucuuucauguucuccuacaucuugcucaccaugugccgcaaccucaucaccuuccugcgagaaaccuuccucaaccgcuacgugcccuucgacgccgccguggacuuccaucgccucauugccuccaccgccaucguccucacagucuuacacagugugggccauguggugaauguguaccuguucuccaucagcccccucagcguccucucuugccucuuuccuggccucuuccaugaugaugggucugagcucccccagaaguauuacuggugguucuuccagaccguaccaggccucacggggguugugcugcuccugauccuggccaucauguaugucuuugccucccaccacuuccgccgccgcaguuuccggggcuucuggcugacccaccaccucuacauccugcucuauguccugcucaucauccaugguagcuuugcccugauccagcugccccguuuccacaucuucuuccuggucccagcaaucaucuaugggggcgacaagcuggugagccugagccggaagaagguggagaucagcguggugaaggcggagcugcugcccucaggagugacccaccugcgguuccagcggccccagggcuuugaguacaagucagggcagugggugcggaucgcuugccuggcucuggggaccaccgaguaccaccccuucacacugaccucugcgccccaugaggacacgcuuagccugcacauccgggcagcagggcccuggaccacucgccucagggagaucuacucagccccgacgggugacagaugugccagauacccaaagcuguaccuugauggaccauuuggagagggccaccaggaguggcauaaguuugaggugucaguguuagugggagggggcauuggggucaccccuuuugccuccauccucaaagaccuggucuucaagucauccgucagcugccaaguguucuguaagaagaucuacuucaucugggugacgcggacccagcgucaguuugaguggcuggcugacaucauccgagagguggaggagaaugaccaccaggaccuggugucugugcacaucuacaucacccagcuggcugagaaguucgaccucaggaccacuaugcuguacaucugugagcggcacuuccagaagguucugaaccggagucuauucacaggccugcgcuccaucacccacuuuggccguccccccuuugagcccuucuucaacucccugcaggagguccacccccagguccggaagaucgggguguuuagcuguggccccccuggcaugaccaagaauguggaaaaggccugucagcucaucaacaggcaggaccggacucacuucucccaccauuaugagaacuucuaggccccugcccggggguucugcccacugcccaguugagcagagguuugagcccacaccucaccucuguucuuccuauuucuggcugccucagccuucucugauuucccaccucccaaccuuguuccagguggccauagucagucaccaugugugggcucagggacccccaggaccaggaugugucucagccuggagaaauggugggggggcagugucuagggacuagagugagaaguaggggagcuacugauuuggggcaaagugaaaccucugcuuccagacuucagaaacaaaucucagaagacaagcugaccugacaaguacuaugugugugcaugucuguauguguguuggggcggugaguguaaggaugcagugggagcauggaugcuggcaucuuagaacccucccuacucccauaccuccuccucuucugggcuccccacugucagacgggcuggcaaaugccuugcaggagguagaggcuggacccauggcaagccauuuacagaaacccacucggcaccccagucuaacaccacaacuaauuucacccaagguuuuaagcacguucuuucaucagacccuggcccaauaccuauguaugcaaugcuccucagcccucuucucccugcuccaguagucucccuuccaaauaaaucacuuuucugccuuaaaaaaaaaaaaaaaa

SEQ ID NO: 113 - RNA, 6428 nt, Homo_Sapiens
ggucuguccugagccgacaccugcacaguggcgagaccaaggacccagagagaaaggugagagugcagccggggaggcugaggaucggcggagcuggaagagugagggugaaggcaagaaguagagcacagaagcaaagauuuuaagaggaaagaagacaucugaacccaacaccacccuaaaccacaggcugcaggguuggcaugcuccgugcaagaccagaggcacugaugcuccugggagcucuucugacuggaucccuggguccaucgggcaaucaggacgcacucucacugcccugggaagugcagcgcuaugacggcugguuuaacaaccugaggcaccacgagcguggugcuguuggcugccgguugcagcgccgcguaccagccaauuacgccgacgguguguaucaggcucuggaggagccgcagcugcccaacccgcgccggcucagcaacgcagccacgcggggcauagccggccugccgucgcuccacaaccgcaccguacugggggucuucuuuggcuaccauguucuuuccgacguggugagcguggaaacgcccgguugccccgccgaguuccucaacauccgcaucccaccuggagaccccguguucgaccccgaccagcgcggggacguggugcugcccuuccagaggagccgcugggaccccgagaccggacggagucccagcaacccccgggaccuggccaaccaggugacgggcuggcuggacggcagcgccaucuauggcuccucgcacuccuggagcgacgcgcugcggagcuucucggggggacagcuggcgucggggcccgaccccgcuuucccccgagacucgcagaacccccugcucaugugggcggcgcccgaccccgccaccgggcagaacgggccccgggggcuguacgccuucggggcagagagagggaaccgggaacccuuccugcaggcgcugggccugcucugguuccgcuaccacaaccugugggcgcagaggcuggcccgccagcacccagacugggaggacgaggagcuguuccagcacgcacgcaagagggucaucgccaccuaccagaacaucgcuguguaugaguggcugcccagcuuccugcagaaaacacucccggaguauacaggauaccguccuuuccuagaccccagcaucuccccggaauuugugguggccucugagcaguucuucucuaccauggugcccccuggugucuacaugagaaaugccagcugucauuuccggaagguccugaacaaggguuuucaaagcucccaagcucucagggucugcaacaacuacuggauucgggagaaccccaaucugaacaguacccaggaggugaaugagcugcugcugggaauggccucccagauuucggaguuggaggacaacauagugguugaagaucugagggauuacuggccuggcccuggcaaauucucccguacagacuauguggccagcagcauccaacguggccgagauauggggcugcccagcuauagccaggcccugcuggccuuugggcuggacaucccaaggaacuggagugaucucaacccuaauguggacccccaggugcuggaggccacagcugcccuguacaaccaggaccuaucccagcuagagcugcuccuuggggggcuccuggagagccauggggacccuggaccccuguucagugccauuguccucgaccaguuuguacggcugcgggauggugaccgcuacugguuugagaacaccaggaaugggcuguucuccaagaaggagauugaagacauccgaaauaccacccugcgggacgugcuggucgcuguuaucaacauugaccccagugcccugcagcccaaugucuuugucuggcauaaaggugcacccugcccucaaccuaagcagcucacaacugacggccugccccagugugcaccccugacugugcuugacuucuuugaaggcagcagcccugguuuugccaucaccaucauugcucucugcugccuucccuuagugagucugcuucucucuggagugguggccuauuuccggggccgagaacacaagaagcuacaaaagaaacucaaagagagcgugaagaaggaagcagccaaagauggagugccagcgauggaguggccaggccccaaggagaggagcagucccaucaucauccagcugcugucagacaggugucugcagguccugaacaggcaucucacugugcuccgugugguccagcugcagccucugcagcaggucaaccucauccuguccaacaaccgaggaugccgcacccugcugcucaagaucccuaaggaguaugaccuggugcugcuguuuaguucugaagaggaacggggcgccuuugugcagcagcuaugggacuucugcgugcgcugggcucugggccuccauguggcugagaugagcgagaaggagcuauuuaggaaggcugugacaaagcagcagcgggaacgcauccuggagaucuucuucagacaccuuuuugcucaggugcuggacaucaaccaggccgacgcagggacccugccccuggacuccucccagaaggugcgggaggcccugaccugcgagcugagcagggccgaguuugccgagucccugggccucaagccccaggacauguuuguggaguccauguucucucuggcugacaaggauggcaauggcuaccuguccuuccgagaguuccuggacauccugguggucuucaugaaaggcuccccagaggauaagucccgucuaauguuuaccauguaugaccuggaugagaauggcuuccucuccaaggacgaauucuucaccaugaugcgauccuucaucgagaucuccaacaacugccuguccaaggcccagcuggccgaggugguggagucuauguuccgggagucgggauuccaggacaaggaggagcugacaugggaggauuuucacuucaugcugcgggaccaugacagcgagcuccgcuucacgcagcucugugucaaagguggagguggagguggaaaugguauuagagauaucuuuaaacaaaacaucagcugucgagucucguucaucacucggacaccuggggagcgcucccacccccagggacuggggcccccugccccagaagccccagagcugggaggcccuggacugaagaagagguuuggcaaaaaggcagcagugcccacuccccggcuguacacagaggcgcugcaagagaagaugcagcgaggcuuccuagcccaaaagcugcagcaguacaagcgcuucguggagaacuaccggaggcacaucguguguguggcaaucuucucggccaucuguguuggcguguuugcagaucgugcuuacuacuauggcuuugccucgccacccucggacauugcacagaccacccucgugggcaucauccugucacgaggcacggcggccagcgucuccuucauguucucuuauaucuugcucaccaugugccgcaaccucauaaccuuccugcgagagacuuuccucaaccgcuaugugccuuuugaugccgcaguggacuuccaccgcuggaucgccauggcugcuguuguccuggccauuuugcacagugcuggccacgcagucaaugucuacaucuucucagucagcccacucagccugcuggccugcauauuccccaacgucuuugugaaugauggguccaagcuuccccagaaguucuauuggugguucuuccagaccgucccagguaugacaggugugcuucugcuccugguccuggccaucauguaugucuucgccucccaccacuuccgccgccgcagcuuccggggcuucuggcugacccaccaccucuacauccugcucuaugcccugcucaucauccauggcagcuaugcucugauccagcugcccacuuuccacaucuacuuccuggucccggcaaucaucuauggaggugacaagcuggugagccugagccggaagaagguggagaucagcguggugaaggcggagcugcugcccucaggagugaccuaccugcaauuccagaggccccaaggcuuugaguacaagucaggacagugggugcggaucgccugccuggcucuggggaccaccgaguaccaccccuucacacugaccuccgcgccccaugaggacacacucagccugcacauccgggcaguggggcccuggaccacucgccucagggagaucuacucauccccaaagggcaauggcugugcuggauacccaaagcuguaccuugauggaccguuuggagagggccaucaggaguggcauaaauuugaggugucaguguuggugggagggggcauuggggucacccccuuugccuccauccucaaagaccuggucuucaagucauccuugggcagccaaaugcuguguaagaagaucuacuucaucugggugacacggacccagcgucaguuugaguggcuggcugacaucauccaagagguggaggagaacgaccaccaggaccuggugucugugcacauuuaugucacccagcuggcugagaaguucgaccucaggaccaccaugcuauacaucugcgagcggcacuuccagaaagugcugaaccggagucuguucacgggccugcgcuccaucacccacuuuggccguccccccuucgagcccuucuucaacucccugcaggagguccacccacaggugcgcaagaucgggguguucagcugcggcccuccaggaaugaccaagaauguagagaaggccugucagcucgucaacaggcaggaccgagcccacuucaugcaccacuaugagaacuucugagccuguccucccuggcugcugcuuccaguauccugccuucucuucugugcaccuaaguugcccagcccugcuggcaaucucuccaucagaauccaccuuaggccucagcuggagggcugcagagccccucccaauauugggagaauauugacccagacaauuauacaaaugagaaaaggcaggagacuauguucuacaauugcagugcaugaugauuauaaguccaccuguuuaucaacggcaccauuccugcagcccuccagacuuccugcccuuagcaagugcgcaaccagucaggaucucccaaagaagauaaagaccacuccucaccccagcucaagccauggcaggcguggcaagcaaaguggggaggagacagucccugcuugugacaaguguggaggugaaaagguacaauagugcuugucuccgauagcuccccacaucucuaauugacuuccacaaaaucgaugcguugcuuugguauuugcuuggacugacauuugagggaggaggaggcugggauccucuggcugagaaucuccucagagcccagugcagaagcugugaugcuuagaaccuggacagcccgacugccucaacucugucuccaggucuauucccuccagcuccaaaaggagcagcccuacuucuaccccuucccguccccaaagugucagcaacuuugaggagggcaccaggaaacaaagaugccuccccagcccugauauucuugaugucaccagugauacccacugcccugaccccugggcaggccccucucugcaucuacuggaguggucccugggcucuggggcugaaggauuccagccucucugccagauauucaguacucgaucucaauuccccucuuccacaagaguugggugaccagcuguccuaguuugcccaggacucucccuguuuuagcacugaaagucucuugccccaggaaaccccaucagucccaggcagauugggacagcuggucaccuuacgcaagagccaggcugaaacauccccuccauacucagcucuuuaacuuuucuuuuccuuuuucaucgggcucuuuccuaaaaagcugagcuguaaaauauuuuacaucgagguauaauaaauaaucauguacauguuuuaccaccacccaggucaagacauagaauguuucaacauuuccaucaccccagaaacuccccuuguacccccuuccacuucgucuccccuagcuccuagaagcaaccacugaugugauuucuaccaaauccaguuuugguccuacuaaauauacucuuuugagacuggccucuuuuacucaccauaaugccuuuguaauucauccaugcuguuguguguaucagcaguuuguuccuuuucauugcugaguaguauucuauuguagagauguaccacaguuuguuuauucuucuguugauggacguuuggguuguuucuaauuuugaaugauuauaaauaaaaauucugugaguguucuuguaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 114 - RNA, 1752 nt, Homo_Sapiens
agggcgcagcaggccaagggggaggugcgagcguggaccugggacgggucugggcggcucucggugguuggcacggguucgcacacccauucaagcggcaggacgcacuugucuuagcaguucucgcugaccgcgcuagcugcggcuucuacgcuccggcacucugaguucaucagcaaacgcccuggcgucuguccucaccaugccuagccuuugggaccgcuucucgucgucguccaccuccucuucgcccucguccuugccccgaacucccaccccagaucggccgccgcgcucagccugggggucggcgacccgggaggagggguuugaccgcuccacgagccuggagagcucggacugcgagucccuggacagcagcaacaguggcuucgggccggaggaagacacggcuuaccuggauggggugucguugcccgacuucgagcugcucagugacccugaggaugaacacuugugugccaaccugaugcagcugcugcaggagagccuggcccaggcgcggcugggcucucgacgcccugcgcgccugcugaugccuagccaguugguaagccaggugggcaaagaacuacugcgccuggccuacagcgagccgugcggccugcggggggcgcugcuggacgucugcguggagcagggcaagagcugccacagcgugggccagcuggcacucgaccccagccuggugcccaccuuccagcugacccucgugcugcgccuggacucacgacucuggcccaagauccaggggcuguuuagcuccgccaacucucccuuccucccuggcuucagccagucccugacgcugagcacuggcuuccgagucaucaagaagaagcuguacagcucggaacagcugcucauugaggaguguugaacuucaaccugagggggccgacagugcccuccaagacagagacgacugaacuuuugggguggagacuagaggcaggagcugagggacugauuccugugguuggaaaacugaggcagccaccuaagguggaggugggggaauaguguuucccaggaagcucauugaguugugugcggguggcugugcauuggggacacauaccccucaguacuguagcaugaaacaaaggcuuaggggccaacaaggcuuccagcuggauguguguguagcauguaccuuauuauuuuuguuacugacaguuaacaguggugugacauccagagagcagcugggcugcucccgccccagcccggcccagggugaaggaagaggcacgugcuccucagagcagccggagggaggggggaggucggaggucguggaggugguuuguguaucuuacuggucugaagggaccaaguguguuuguuguuuguuuuguaucuuguuuuucugaucggagcaucacuacugaccuguuguaggcagcuaucuuacagacgcaugaauguaagaguaggaaggggugggugucagggaucacuugggaucuuugacacuugaaaaauuacaccuggcagcugcguuuaagccuucccccaucguguacugcagaguugagcuggcaggggaggggcugagagggugggggcuggaaccccuccccgggaggagugccaucugggucuuccaucuagaacuguuuacaugaagauaagauacucacuguucaugaauacacuugauguucaaguauuaagaccuaugcaauauuuuuuacuuuucuaauaaacauguuuguuaaaacaguu

SEQ ID NO: 115 - RNA, 2607 nt, Homo_Sapiens
agccggcgcaggguggccggggaggggugagcagggugccgcuggcugcuggggucugcaggucaccgaguccccaggagaggggacuccuaagaagccaccugccuguguuuacccggcagcgagcgcgcaggcccccgcgaacuccuggcagcgcucaggaaaggccguugcgccucgcgaaggaaacagagccguugaccaugguugcaacuggcaguuugagcagcaagaacccggccagcauuucagaauugcuggacuguggcuaucacccagagagccugcuaagugauuuugacuacugggauuauguuguuccugaacccaaccucaacgagguaauauuugaggaaucaacuugccagaauuugguuaaaaugcuggagaacugucuguccaaaucaaagcaaacuaaacuugguugcucaaagguccuugucccugagaaacugacccagagaauugcucaagauguccugcggcuuuccucaacggagcccugcggcuugcgagguuguguuaugcacgugaacuuggaaauugaaaauguauguaaaaagcuggauaggauugugugugauucuagcgucguaccuacuuuugagcuuacacuuguguuuaagcaggagaacugcucauggacuagcuucagggacuuuuucuuuaguagaggucgcuucuccucugguuucaggagaacucugauccucagcucaggauuucgacuuguuaagaaaaaacuuuacucacugauuggaacaacagugauugaaggguccuaaaaagggaaaauauauaaagauuauuucaugauuggguaguaaaacuauucagcuagucagcuaaagucauuuguaguuugccccaccugcccuaaauaagaaaccccaaauguagucucuuuucuuucuguguuucacauucauagcaacugcagcuaacaggcugauuuucuggccuuuggagaagugauucaaaauaguguagauuuucugcauagaucccauuuuuguacagaauugaaugggauggaauagguaagcaaaaguagaagcccauuugaguuuuacauuugauuccacaauuugguuucagguaggcuugguaauagacuauauaaaccagauuugccuauuuugauuuucauauggcuuuuuuuucucuaaguuuucagaggauuuuuuaaaucacagaaucauacuaaaugauauuuagccuaucaaaacuuccaaaagcccacaccaccaguuccugacucaaauuugaaggguuuuuagacaggaagguaggauuaaguaggugaguuuaauuaaagcuuaacccuagguaagaguaaaugagaaauauuacggcaauaauggaacugcuucacuguuucuuggugacuuccucacucuaauguuuuaaagaggcaacaaaagcuuguggugccauuucaguaaccacgguguuguuuuagaugccuuuauaagcucaguuuccccuguucuuaaguguugaauacugucuuuaaacuagaaaaaugcaaaauauugaacugauauuuuuguguguaguugauuacucuuccauugagugaaugaugaauaccugugaggauaggaaauuaguucugagaucuagucccucucugauucacuuaguaaucuauccucuuuucaguauuacaugugcuuaaucucagaugaaccauuucaccauggcaguguuaucucaucucugggcuuuucugggaauugaaguaucucuccuuaaccccaauugucaaggguaguagcuguauacuaccacuuugaauuauugaaacgggucaauuuacgaagucugcauuggcuauggagauaugguuuauaguacagccuagagaaugaaacucaccguccagauaaccaugcaugcacccagauuuuuuccaccuuggauaccugucacuagggaauaauaaaggccuuauuuuuugucuuauuccaacuaaguagaucauuaucucuuuccuuuuuuauguuaaugagagaauuuagccuccacucaacaauguucaauucagcaaggcuuucauauccuugcugugggucguggauaaggagcuuauucagguuuccugcccuagcuauuagcuccacuucacaugcuggagaccggcguagggacagauguauucauccugguguuacugaaaaacaggugugauccuguuacugauacuauaagugaccuaaaaugucacuguucaaauuagccaguguucuaacaaacuaaacucuucaaaugcuuggaaagauacuacaaagccaaucuuuauagaauugggccaagauaaaucaauguuguuuugcaugucuauuguuaagcuccaaagguucacuguguuucugccgcuguccuggaguugucaccacugacugggcaaggcuucuugggcaucgauguagaacuguuguccuuuuuccacuaacaguuaucuuugacucucuugccuguuaugcuuacaaaauggugauggcuuauggaaggcuguuaaauuaauauuccuguuaaaggaaauuaaaguuugucuauuuuugacaauaaaacauuauauauuuuuaaaaaaaaaaaaaaaaa

SEQ ID NO: 116 - RNA, 4390 nt, Homo_Sapiens
ugagugggcagagcugacccggugcgggugggagucagggcgcccggaaaacccggcucuggguagcagaccccgcccgggcuggcucggcgccgggccuucgggcuuccacucagucuuugacccucgguccucgcucagcggcccggcaggccgcacaacuguaaccgcugccccggccgccgcccgcuccuucucgguccggcgggcacagagcgcagcgcggcggggccggcggcauggcuguguccuggaggagcuggcucgccaacgaagggguuaaacaccucugccuguucaucuggcucuccaugaauguccugcuuuucuggaaaaccuucuugcuguauaaccaagggccagaguaucacuaccuccaccagauguuggggcuaggauugugucuaagcagagccucagcaucuguucuuaaccucaacugcagccuuauccuuuuacccaugugccgaacacucuuggcuuaccuccgaggaucacagaagguuccaagcaggagaaccaggagauuguuggauaaaagcagaacauuccauauuaccugugguguuacuaucuguauuuucucaggcgugcauguggcugcccaucuggugaaugcccucaacuucucagugaauuacagugaagacuuuguugaacugaaugcagcaagauaccgagaugaggauccuagaaaacuucucuucacaacuguuccuggccugacaggggucugcauggugguggugcuauuccucaugaucacagccucuacauaugcaauaagaguuucuaacuaugauaucuucugguauacucauaaccucuucuuugucuucuacaugcugcugacguugcauguuucaggagggcugcugaaguaucaaacuaauuuagauacccacccucccggcugcaucagucuuaaccgaaccagcucucagaauauuuccuuaccagaguauuucucagaacauuuucaugaaccuuucccugaaggauuuucaaaaccggcagaguuuacccagcacaaauuugugaagauuuguauggaagagcccagauuccaagcuaauuuuccacagacuuggcuuuggauuucuggaccuuugugccuguacugugccgaaagacuuuacagguauauccggagcaauaagccagucaccaucauuucggucauaagucaucccucagaugucauggaaauccgaauggucaaagaaaauuuuaaagcaagaccuggucaguauauuacucuacauugucccaguguaucugcauuagaaaaucauccauuuacccucacaauguguccaacugaaaccaaagcaacauuugggguucaucuuaaaauaguaggagacuggacagaacgauuucgagauuuacuacugccuccaucuagucaagacuccgaaauucugcccuucauucaaucuagaaauuaucccaagcuguauauugaugguccuuuuggaaguccauuugaggaaucacugaacuaugaggucagccucugcguggcuggaggcauuggaguaacuccauuugcaucaauacucaacacccuguuggaugacuggaaaccauacaagcuuagaagacuauacuuuauuuggguaugcagagauauccaguccuuccguugguuugcagauuuacucuguauguugcauaacaaguuuuggcaagagaacagaccugacuaugucaacauccagcuguaccucagucaaacagaugggauacagaagauaauuggagaaaaauaucaugcacugaauucaagacuguuuauaggacguccucgguggaaacuuuuguuugaugaaauagcaaaauauaacagaggaaaaacaguugguguuuucuguuguggacccaauucacuauccaagacucuucauaaacugaguaaccagaacaacucauaugggacaagauuugaauacaauaaagagucuuucagcugaaaacuuuugccaugaagcaggacucuaaagaaggaaugagugcaauuucuaagacuuugaaacucagcggaaucaaucagcuguguuaugccaaagaauaguaagguuuucuuauuuaugauuauuuaaaauggaaaugugagaauguggcaagaugaccgucacauuacauguuuaaucuggaaaccaaagagacccugaagaauauuugaugugaugauucacuuuucaguucucaaauuaaaagaaaacuguuagaugcacacuguugauuuucaugguggauucaagaacucccuagugaggagcugaacuugcucaaucuaaggcugauugucguguuccucuuuaaauuguuuuugguugaacaaaugcaagauugaacaaaauuaaaaauucauugaagcugaaauuccauuuucuguguuguguauaaacagaguagcuuuaauuugcaagcacuccaggcaaauauauuagauguuugaaaacacagcacaagacucuguauugauacggguacuuugugucaauaucuaaucgucuccacuacuuaugcuaauaccucuauuugauaucugaagacuauaugcuaacugaaccuuccucaaauguuguuauaguaucuauuuuuauauauuuuuuucuuuuuauuccucucucuagggaaauaugccuucccuuagcaugcauuagacauaaugauuuaauaggucccuuucaucuucauuuaaaucuaucacuauugcaugguaaugaaaauauuccuacuauaaauuauaaagggauauauauauauggauauauauauguauauacacauauauauauacacacacacacacauauauauauauauauauauauauacacauauacuaauaacuuuucccuuuuuucagcauuuuugucucuauuauuauuauuguuuuuuucccagguaggguuugucuuaggcuguagccucuaaggauaguuaguuaauuugcacuuugagaccaaaggacaucaugugugucaguagggacugaauauaagauuuaucuccuuugccacacauugguuuaugauggagacauugaaagucuagucauauuccugaacaguaaaaccuguauuuuaccuuuuaaguaagaggaaauaugauauucuuauucaaacuuaaguuuagaauccagaauauuacugucgcacuuuuugguauccugaguuuccauagggaacuauuggguuuaaagucaccguuggaacuacacugugugaucuuauaaacuuauguucccuggcuaucauauucuuggcucagaacaauauuucccauuacuaucuuaagaauuaaggcauucauggcucacgccuguaaucccggcacuuugggaggccaaggcagguggaucacgaggucagaguucaagaccagccugaccaaguuggugaaaccccaucgcuacuaaaaauacaaauauuaggcgggugugguggcgggugccuauaaucccaacuacucgggagacugaggcaaagaaucgcuugaacccggugggcggagguugcagugagccaagauugcaccacugcacuccagccugggugacagagcaagauuccaucucaaaaaaaaaaaaaaaaaaaaaaaaaaagaauuaaagcauucauacaguuuagugauuuuguuuaguagucggcuaucaauugcuaucaaauauaacacugcugaaaucagcagugugacuuaccuugccauuguuaaaauguuacauaaaacauaacaugauagaugcuaaggccuuuuuuugcuauaauucaccaauagcaaucaagcaugcuaacccauacugaaugauauuuacuuguagauauuucuuccuuuccuugaaauucuccuuucuauggaaagaagaugaacccaaaaaagugauaggaaauguggaaugcucaugcagauuuagcucugaaggcauauuuaauaacuaguaugucuugacaacagucuuuagauuaaaaagaauuuucauggaaacauuuaacagaaagaacuaguaaaaagacacuuugaguuaguccaggcuuaaugugcaauacugacucuauacugaucauaauuuauuuaugcgaucauauuaauagaccuaauuucauuaaaacagguagaagauuuuucaaaagaaagaugauguuucaaagcuggucugccauucuagaugagccuccuugcuuauuuaaguuccaguagguguucaaauguuaaauguuaaacauaggucaucuuugcuucugcagggcuucaucuugcauguuuaagagaacuuuguuuuauuuugagggauuauuucucuggggaucauucuuauaauacaagccuuaaaucacuaauuuuaguagcaauaaauguuaaaauugaaaaaaaaaaaaaa

SEQ ID NO: 117 - RNA, 4270 nt, Homo_Sapiens
ugagugggcagagcugacccggugcgggugggagucagggcgcccggaaaacccggcucuggguagcagaccccgcccgggcuggcucggcgccgggccuucgggcuuccacucagucuuugacccucgguccucgcucagcggcccggcaggccgcacaacuguaaccgcugccccggccgccgcccgcuccuucucgguccggcgggcacagagcgcagcgcggcggggccggcggcauggcuguguccuggaggagcuggcucgccaacgaagggguuaaacaccucugccuguucaucuggcucuccaugaauguccugcuuuucuggaaaaccuucuugcuguauaaccaagggccagaguaucacuaccuccaccagauguuggggcuaggauugugucuaagcagagccucagcaucuguucuuaaccucaacugcagccuuauccuuuuacccaugugccgaacacucuuggcuuaccuccgaggaucacagaagguuccaagcaggagaaccaggagauuguuggauaaaagcagaacauuccauauuaccugugguguuacuaucuguauuuucucaggcgugcauguggcugcccaucuggugaaugcccucaacuucucagugaauuacagugaagacuuuguugaacugaaugcagcaagauaccgagaugaggauccuagaaaacuucucuucacaacuguuccuggccugacaggggucugcauggugguggugcuauuccucaugaucacagccucuacauaugcaauaagaguuucuaacuaugauaucuucugguauacucauaaccucuucuuugucuucuacaugcugcugacguugcauguuucaggagggcugcugaaguaucaaacuaauuuagauacccacccucccggcugcaucagucuuaaccgaaccagcucucagaauauuuccuuaccagaguauuucucagaacauuuucaugaaccuuucccugaaggauuuucaaaaccggcagaguuuacccagcacaaauuugugaagauuuguauggaagagcccagauuccaagcuaauuuuccacagacuuggcuuuggauuucuggaccuuugugccuguacugugccgaaagacuuuacagguauauccggagcaauaagccagucaccaucauuucggucauaagucaucccucagaugucauggaaauccgaauggucaaagaaaauuuuaaagcaagaccuggucaguauauuacucuacauugucccaguguaucugcauuagaaaaucauccauuuacccucacaauguguccaacugaaaccaaagcaacauuugggguucaucuuaaaauaguaggagacuggacagaacgauuucgagauuuacuacugccuccaucuagucaagacuccgaaauucugcccuucauucaaucuagaaauuaucccaaggaugacuggaaaccauacaagcuuagaagacuauacuuuauuuggguaugcagagauauccaguccuuccguugguuugcagauuuacucuguauguugcauaacaaguuuuggcaagagaacagaccugacuaugucaacauccagcuguaccucagucaaacagaugggauacagaagauaauuggagaaaaauaucaugcacugaauucaagacuguuuauaggacguccucgguggaaacuuuuguuugaugaaauagcaaaauauaacagaggaaaaacaguugguguuuucuguuguggacccaauucacuauccaagacucuucauaaacugaguaaccagaacaacucauaugggacaagauuugaauacaauaaagagucuuucagcugaaaacuuuugccaugaagcaggacucuaaagaaggaaugagugcaauuucuaagacuuugaaacucagcggaaucaaucagcuguguuaugccaaagaauaguaagguuuucuuauuuaugauuauuuaaaauggaaaugugagaauguggcaagaugaccgucacauuacauguuuaaucuggaaaccaaagagacccugaagaauauuugaugugaugauucacuuuucaguucucaaauuaaaagaaaacuguuagaugcacacuguugauuuucaugguggauucaagaacucccuagugaggagcugaacuugcucaaucuaaggcugauugucguguuccucuuuaaauuguuuuugguugaacaaaugcaagauugaacaaaauuaaaaauucauugaagcugaaauuccauuuucuguguuguguauaaacagaguagcuuuaauuugcaagcacuccaggcaaauauauuagauguuugaaaacacagcacaagacucuguauugauacggguacuuugugucaauaucuaaucgucuccacuacuuaugcuaauaccucuauuugauaucugaagacuauaugcuaacugaaccuuccucaaauguuguuauaguaucuauuuuuauauauuuuuuucuuuuuauuccucucucuagggaaauaugccuucccuuagcaugcauuagacauaaugauuuaauaggucccuuucaucuucauuuaaaucuaucacuauugcaugguaaugaaaauauuccuacuauaaauuauaaagggauauauauauauggauauauauauguauauacacauauauauauacacacacacacacauauauauauauauauauauauauacacauauacuaauaacuuuucccuuuuuucagcauuuuugucucuauuauuauuauuguuuuuuucccagguaggguuugucuuaggcuguagccucuaaggauaguuaguuaauuugcacuuugagaccaaaggacaucaugugugucaguagggacugaauauaagauuuaucuccuuugccacacauugguuuaugauggagacauugaaagucuagucauauuccugaacaguaaaaccuguauuuuaccuuuuaaguaagaggaaauaugauauucuuauucaaacuuaaguuuagaauccagaauauuacugucgcacuuuuugguauccugaguuuccauagggaacuauuggguuuaaagucaccguuggaacuacacugugugaucuuauaaacuuauguucccuggcuaucauauucuuggcucagaacaauauuucccauuacuaucuuaagaauuaaggcauucauggcucacgccuguaaucccggcacuuugggaggccaaggcagguggaucacgaggucagaguucaagaccagccugaccaaguuggugaaaccccaucgcuacuaaaaauacaaauauuaggcgggugugguggcgggugccuauaaucccaacuacucgggagacugaggcaaagaaucgcuugaacccggugggcggagguugcagugagccaagauugcaccacugcacuccagccugggugacagagcaagauuccaucucaaaaaaaaaaaaaaaaaaaaaaaaaaagaauuaaagcauucauacaguuuagugauuuuguuuaguagucggcuaucaauugcuaucaaauauaacacugcugaaaucagcagugugacuuaccuugccauuguuaaaauguuacauaaaacauaacaugauagaugcuaaggccuuuuuuugcuauaauucaccaauagcaaucaagcaugcuaacccauacugaaugauauuuacuuguagauauuucuuccuuuccuugaaauucuccuuucuauggaaagaagaugaacccaaaaaagugauaggaaauguggaaugcucaugcagauuuagcucugaaggcauauuuaauaacuaguaugucuugacaacagucuuuagauuaaaaagaauuuucauggaaacauuuaacagaaagaacuaguaaaaagacacuuugaguuaguccaggcuuaaugugcaauacugacucuauacugaucauaauuuauuuaugcgaucauauuaauagaccuaauuucauuaaaacagguagaagauuuuucaaaagaaagaugauguuucaaagcuggucugccauucuagaugagccuccuugcuuauuuaaguuccaguagguguucaaauguuaaauguuaaacauaggucaucuuugcuucugcagggcuucaucuugcauguuuaagagaacuuuguuuuauuuugagggauuauuucucuggggaucauucuuauaauacaagccuuaaaucacuaauuuuaguagcaauaaauguuaaaauugaaaaaaaaaaaaaa

SEQ ID NO: 118 - RNA, 4615 nt, Homo_Sapiens
acacuucacucaaauggcuggcugcagcuggugcuaguuauggucugggaucucagaugaggcugcuaagccgaauguguuguuacuccuuuacaucgucucuccacauggcuugaacuucucacagcaugccugcuggauucgaagagauggcauucaagugcuuaaaaaucaagaagacccucaccaggugccagcgucuagacauuggauuuuccagccuccagaacuuacuucuagucuaguuggagaaacaaccuagaaaaugcaccaacaaauggggcacaauaacuacucugagagagaguggcacacaguggacgcaaagaagagguuccugaugcagcugggaagagucuacaugggccucuagcaggagaagauacuggucuugaguuuggagacuaaguaagcaucuccagugucgaauagguaccugggucaacuccacacacuucucacucuucacuggaccucugguacaagauugagaggauuccuauuacuuacaaacagacuaguucaucuggcucuccaugaauguccugcuuuucuggaaaaccuucuugcuguauaaccaagggccagaguaucacuaccuccaccagauguuggggcuaggauugugucuaagcagagccucagcaucuguucuuaaccucaacugcagccuuauccuuuuacccaugugccgaacacucuuggcuuaccuccgaggaucacagaagguuccaagcaggagaaccaggagauuguuggauaaaagcagaacauuccauauuaccugugguguuacuaucuguauuuucucaggcgugcauguggcugcccaucuggugaaugcccucaacuucucagugaauuacagugaagacuuuguugaacugaaugcagcaagauaccgagaugaggauccuagaaaacuucucuucacaacuguuccuggccugacaggggucugcauggugguggugcuauuccucaugaucacagccucuacauaugcaauaagaguuucuaacuaugauaucuucugguauacucauaaccucuucuuugucuucuacaugcugcugacguugcauguuucaggagggcugcugaaguaucaaacuaauuuagauacccacccucccggcugcaucagucuuaaccgaaccagcucucagaauauuuccuuaccagaguauuucucagaacauuuucaugaaccuuucccugaaggauuuucaaaaccggcagaguuuacccagcacaaauuugugaagauuuguauggaagagcccagauuccaagcuaauuuuccacagacuuggcuuuggauuucuggaccuuugugccuguacugugccgaaagacuuuacagguauauccggagcaauaagccagucaccaucauuucggucauaagucaucccucagaugucauggaaauccgaauggucaaagaaaauuuuaaagcaagaccuggucaguauauuacucuacauugucccaguguaucugcauuagaaaaucauccauuuacccucacaauguguccaacugaaaccaaagcaacauuugggguucaucuuaaaauaguaggagacuggacagaacgauuucgagauuuacuacugccuccaucuagucaagacuccgaaauucugcccuucauucaaucuagaaauuaucccaagcuguauauugaugguccuuuuggaaguccauuugaggaaucacugaacuaugaggucagccucugcguggcuggaggcauuggaguaacuccauuugcaucaauacucaacacccuguuggaugacuggaaaccauacaagcuuagaagacuauacuuuauuuggguaugcagagauauccaguccuuccguugguuugcagauuuacucuguauguugcauaacaaguuuuggcaagagaacagaccugacuaugucaacauccagcuguaccucagucaaacagaugggauacagaagauaauuggagaaaaauaucaugcacugaauucaagacuguuuauaggacguccucgguggaaacuuuuguuugaugaaauagcaaaauauaacagaggaaaaacaguugguguuuucuguuguggacccaauucacuauccaagacucuucauaaacugaguaaccagaacaacucauaugggacaagauuugaauacaauaaagagucuuucagcugaaaacuuuugccaugaagcaggacucuaaagaaggaaugagugcaauuucuaagacuuugaaacucagcggaaucaaucagcuguguuaugccaaagaauaguaagguuuucuuauuuaugauuauuuaaaauggaaaugugagaauguggcaagaugaccgucacauuacauguuuaaucuggaaaccaaagagacccugaagaauauuugaugugaugauucacuuuucaguucucaaauuaaaagaaaacuguuagaugcacacuguugauuuucaugguggauucaagaacucccuagugaggagcugaacuugcucaaucuaaggcugauugucguguuccucuuuaaauuguuuuugguugaacaaaugcaagauugaacaaaauuaaaaauucauugaagcugaaauuccauuuucuguguuguguauaaacagaguagcuuuaauuugcaagcacuccaggcaaauauauuagauguuugaaaacacagcacaagacucuguauugauacggguacuuugugucaauaucuaaucgucuccacuacuuaugcuaauaccucuauuugauaucugaagacuauaugcuaacugaaccuuccucaaauguuguuauaguaucuauuuuuauauauuuuuuucuuuuuauuccucucucuagggaaauaugccuucccuuagcaugcauuagacauaaugauuuaauaggucccuuucaucuucauuuaaaucuaucacuauugcaugguaaugaaaauauuccuacuauaaauuauaaagggauauauauauauggauauauauauguauauacacauauauauauacacacacacacacauauauauauauauauauauauauacacauauacuaauaacuuuucccuuuuuucagcauuuuugucucuauuauuauuauuguuuuuuucccagguaggguuugucuuaggcuguagccucuaaggauaguuaguuaauuugcacuuugagaccaaaggacaucaugugugucaguagggacugaauauaagauuuaucuccuuugccacacauugguuuaugauggagacauugaaagucuagucauauuccugaacaguaaaaccuguauuuuaccuuuuaaguaagaggaaauaugauauucuuauucaaacuuaaguuuagaauccagaauauuacugucgcacuuuuugguauccugaguuuccauagggaacuauuggguuuaaagucaccguuggaacuacacugugugaucuuauaaacuuauguucccuggcuaucauauucuuggcucagaacaauauuucccauuacuaucuuaagaauuaaggcauucauggcucacgccuguaaucccggcacuuugggaggccaaggcagguggaucacgaggucagaguucaagaccagccugaccaaguuggugaaaccccaucgcuacuaaaaauacaaauauuaggcgggugugguggcgggugccuauaaucccaacuacucgggagacugaggcaaagaaucgcuugaacccggugggcggagguugcagugagccaagauugcaccacugcacuccagccugggugacagagcaagauuccaucucaaaaaaaaaaaaaaaaaaaaaaaaaaagaauuaaagcauucauacaguuuagugauuuuguuuaguagucggcuaucaauugcuaucaaauauaacacugcugaaaucagcagugugacuuaccuugccauuguuaaaauguuacauaaaacauaacaugauagaugcuaaggccuuuuuuugcuauaauucaccaauagcaaucaagcaugcuaacccauacugaaugauauuuacuuguagauauuucuuccuuuccuugaaauucuccuuucuauggaaagaagaugaacccaaaaaagugauaggaaauguggaaugcucaugcagauuuagcucugaaggcauauuuaauaacuaguaugucuugacaacagucuuuagauuaaaaagaauuuucauggaaacauuuaacagaaagaacuaguaaaaagacacuuugaguuaguccaggcuuaaugugcaauacugacucuauacugaucauaauuuauuuaugcgaucauauuaauagaccuaauuucauuaaaacagguagaagauuuuucaaaagaaagaugauguuucaaagcuggucugccauucuagaugagccuccuugcuuauuuaaguuccaguagguguucaaauguuaaauguuaaacauaggucaucuuugcuucugcagggcuucaucuugcauguuuaagagaacuuuguuuuauuuugagggauuauuucucuggggaucauucuuauaauacaagccuuaaaucacuaauuuuaguagcaauaaauguuaaaauugaaaaaaaaaaaaaa

SEQ ID NO: 119 - RNA, 2529 nt, Homo_Sapiens
gcugauagcacaguucuguccagagaaggaaggcagaauaaacuuauucauucccaggaacucuugggguagguguguguuuuucacaucuuaaaggcucacagacccugcgcuggacaaauguuccauuccugaaggaccucuccagaauccggauugcugaaucuucccuguugccuagaagggcuccaaaccaccucuugacaaugggaaacugggugguuaaccacugguuuucaguuuuguuucugguuguuugguuagggcugaauguuuuccuguuuguggaugccuuccugaaauaugagaaggccgacaaauacuacuacacaagaaaaauccuugggucaacauuggccugugcccgagcgucugcucucugcuugaauuuuaacagcacgcugauccugcuuccugugugucgcaaucugcuguccuuccugaggggcaccugcucauuuugcagccgcacacugagaaagcaauuggaucacaaccucaccuuccacaagcugguggccuauaugaucugccuacauacagcuauucacaucauugcacaccuguuuaacuuugacugcuauagcagaagccgacaggccacagauggcucccuugccuccauucucuccagccuaucucaugaugagaaaaagggggguucuuggcuaaaucccauccagucccgaaacacgacaguggaguaugugacauucaccagcauugcuggucucacuggagugaucaugacaauagccuugauucucaugguaacuucagcuacugaguucauccggaggaguuauuuugaagucuucugguauacucaccaccuuuuuaucuucuauauccuuggcuuagggauucacggcauugguggaauuguccggggucaaacagaggagagcaugaaugagagucauccucgcaagugugcagagucuuuugagaugugggaugaucgugacucccacuguaggcgcccuaaguuugaagggcaucccccugagucuuggaaguggauccuugcaccggucauucuuuauaucugugaaaggauccuccgguuuuaccgcucccagcagaagguugugauuaccaagguuguuaugcacccauccaaaguuuuggaauugcagaugaacaagcguggcuucagcauggaaguggggcaguauaucuuuguuaauugccccucaaucucucuccuggaauggcauccuuuuacuuugaccucugcuccagaggaagauuucuucuccauucauauccgagcagcaggggacuggacagaaaaucucauaagggcuuucgaacaacaauauucaccaauucccaggauugaaguggauggucccuuuggcacagccagugaggauguuuuccaguaugaaguggcugugcugguuggagcaggaauuggggucacccccuuugcuucuaucuugaaauccaucugguacaaauuccagugugcagaccacaaccucaaaacaaaaaagaucuauuucuacuggaucugcagggagacaggugccuuuuccugguucaacaaccuguugacuucccuggaacaggagauggaggaauuaggcaaaguggguuuucuaaacuaccgucucuuccucaccggaugggacagcaauauuguuggucaugcagcauuaaacuuugacaaggccacugacaucgugacaggucugaaacagaaaaccuccuuugggagaccaaugugggacaaugaguuuucuacaauagcuaccucccaccccaagucuguagugggaguuuucuuauguggcccucggacuuuggcaaagagccugcgcaaaugcugucaccgauauuccagucuggauccuagaaagguucaauucuacuucaacaaagaaaauuuuugaguuauaggaauaaggacgguaaucugcauuuugucucuuuguaucuucaguaauuuacuuggucucgucagguuugagcagucacuuuaggauaagaaugugccucucaagccuugacucccugguauucuuuuuuugauugcauucaacuucguuacuugagcuucagcaacuuaagaacuucugaaguucuuaaaguucugaaguucuuaaagcccauggauccuuucucagaaaaauaacuguaaaucuuucuggacagccaugacuguagcaaggcuugauagcagagguuuggugguucagaguuauacaacuaaucccaggugauuuuaucaauuccaguguuaccaucuccugaguuuugguuuguaaucuuuugucccucccacccccacagaagauuucuaaguagggugacuuuuuaaauaaaaauuuauugaauaauuaaugauaaaacauaauaauaaacauaaauaauaaacaaaauuaccgagaaccccauccccauauaacaccaacaguguacauguuuacugucacuuuugauauggucuuauccagugugaacagcaauuuauucuuauuuuugcucaucaaaaaauaaaggauuuucuucuucacuuga

SEQ ID NO: 120 - RNA, 2382 nt, Homo_Sapiens
gcugauagcacaguucuguccagagaaggaaggcagaauaaacuuauucauucccaggaacucuugggguagguguguguuuuucacaucuuaaaggcucacagacccugcgcuggacaaauguuccauuccugaaggaccucuccagaauccggauugcugaaucuucccuguugccuagaagggcuccaaaccaccucuugacaaugggaaacugggugguuaaccacugguuuucaguuuuguuucugguuguuugguuagggcugaauguuuuccuguuuguggaugccuuccugaaauaugagaaggccgacaaauacuacuacacaagaaaaauccuugggucaacauuggccugugcccgagcgucugcucucugcuugaauuuuaacagcacgcugauccugcuuccugugugucgcaaucugcuguccuuccugaggggcaccugcucauuuugcagccgcacacugagaaagcaauuggaucacaaccucaccuuccacaagcugguggccuauaugaucugccuacauacagcuauucacaucauugcacaccuguuuaacuuugacugcuauagcagaagccgacaggccacagauggcucccuugccuccauucucuccagccuaucucaugaugagaaaaagggggguucuuggcuaaaucccauccagucccgaaacacgacaguggaguaugugacauucaccagcauugcuggucucacuggagugaucaugacaauagccuugauucucaugguaacuucagcuacugaguucauccggaggaguuauuuugaagucuucugguauacucaccaccuuuuuaucuucuauauccuuggcuuagggauucacggcauugguggaauuguccggggucaaacagaggagagcaugaaugagagucauccucgcaagugugcagagucuuuugagaugugggaugaucgugacucccacuguaggcgcccuaaguuugaagggcaucccccugagucuuggaaguggauccuugcaccggucauucuuuauaucugugaaaggauccuccgguuuuaccgcucccagcagaagguugugauuaccaagguuguuaugcacccauccaaaguuuuggaauugcagaugaacaagcguggcuucagcauggaaguggggcaguauaucuuuguuaauugccccucaaucucucuccuggaauggcauccuuuuacuuugaccucugcuccagaggaagauuucuucuccauucauauccgagcagcaggggacuggacagaaaaucucauaagggcuuucgaacaacaauauucaccaauucccaggauugaaguggauggucccuuuggcacagccagugaggauguuuuccaguaugaaguggcugugcugguuggagcaggaauuggggucacccccuuugcuucuaucuugaaauccaucugguacaaauuccagugugcagaccacaaccucaaaacaaaaaagguuggucaugcagcauuaaacuuugacaaggccacugacaucgugacaggucugaaacagaaaaccuccuuugggagaccaaugugggacaaugaguuuucuacaauagcuaccucccaccccaagucuguagugggaguuuucuuauguggcccucggacuuuggcaaagagccugcgcaaaugcugucaccgauauuccagucuggauccuagaaagguucaauucuacuucaacaaagaaaauuuuugaguuauaggaauaaggacgguaaucugcauuuugucucuuuguaucuucaguaauuuacuuggucucgucagguuugagcagucacuuuaggauaagaaugugccucucaagccuugacucccugguauucuuuuuuugauugcauucaacuucguuacuugagcuucagcaacuuaagaacuucugaaguucuuaaaguucugaaguucuuaaagcccauggauccuuucucagaaaaauaacuguaaaucuuucuggacagccaugacuguagcaaggcuugauagcagagguuuggugguucagaguuauacaacuaaucccaggugauuuuaucaauuccaguguuaccaucuccugaguuuugguuuguaaucuuuugucccucccacccccacagaagauuucuaaguagggugacuuuuuaaauaaaaauuuauugaauaauuaaugauaaaacauaauaauaaacauaaauaauaaacaaaauuaccgagaaccccauccccauauaacaccaacaguguacauguuuacugucacuuuugauauggucuuauccagugugaacagcaauuuauucuuauuuuugcucaucaaaaaauaaaggauuuucuucuucacuuga

SEQ ID NO: 121 - RNA, 4353 nt, Homo_Sapiens
auuggaagaagaagcauaguauagaagaaaggcaaacacaacacauucaaccucugccaccauggggaacugggcugugaaugaggggcucuccauuuuugucauucugguuuggcugggguugaacgucuuccucuuugucugguauuaccggguuuaugauauuccaccuaaguucuuuuacacaagaaaacuucuugggucagcacuggcacuggccagggccccugcagccugccugaauuucaacugcaugcugauucucuugccagucugucgaaaucugcuguccuuccucagggguuccagugcgugcugcucaacaagaguucgaagacaacuggacaggaaucucaccuuucauaaaaugguggcauggaugauugcacuucacucugcgauucacaccauugcacaucuauuuaauguggaauggugugugaaugcccgagucaauaauucugauccuuauucaguagcacucucugaacuuggagacaggcaaaaugaaaguuaucucaauuuugcucgaaagagaauaaagaacccugaaggaggccuguaccuggcugugacccuguuggcaggcaucacuggaguugucaucacgcugugccucauauuaauuaucacuuccuccaccaaaaccauccggaggucuuacuuugaagucuuuugguacacacaucaucucuuugugaucuucuucauuggccuugccauccauggagcugaacgaauuguacgugggcagaccgcagagaguuuggcugugcauaauauaacaguuugugaacaaaaaaucucagaauggggaaaaauaaaggaaugcccaaucccucaguuugcuggaaacccuccuaugacuuggaaauggauagugggucccauguuucuguaucucugugagagguuggugcgguuuuggcgaucucaacagaagguggucaucaccaagguggucacucacccuuucaaaaccaucgagcuacagaugaagaagaagggguucaaaauggaagugggacaauacauuuuugucaagugcccaaagguguccaagcuggaguggcacccuuuuacacugacauccgccccugaggaagacuucuuuaguauccauauccgcaucguuggggacuggacagaggggcuguucaaugcuuguggcugugauaagcaggaguuucaagaugcguggaaacuaccuaagauagcgguugaugggcccuuuggcacugccagugaagauguguucagcuaugagguggugauguuagugggagcagggauuggggucacacccuucgcauccauucucaagucagucugguacaaauauugcaauaacgccaccaaucugaagcucaaaaagaucuacuucuacuggcugugccgggacacacaugccuuugagugguuugcagaucugcugcaacugcuggagagccagaugcaggaaaggaacaaugccggcuuccucagcuacaacaucuaccucacuggcugggaugagucucaggccaaucacuuugcugugcaccaugaugaggagaaagaugugaucacaggccugaaacaaaagacuuuguauggacggcccaacugggauaaugaauucaagacaauugcaagucaacacccuaauaccagaauaggaguuuuccucuguggaccugaagccuuggcugaaacccugaguaaacaaagcaucuccaacucugagucuggcccucggggagugcauuucauuuucaacaaggaaaacuucuaacuugucucuuccaugaggaaauaaauguggguugugcugccaaaugcucaaauaaugcuaauugauaauauaaauacccccugcuuaaaaauggacaaaaagaaacuauaauguaaugguuuucccuuaaaggaaugucaaagauuguuugauagugauaaguuacauuuauguggagcucuaugguuuugagagcacuuuuacaaacauuauuucauuuuuuuccucucaguaaugucaguggaaguuagggaaaagauucuuggacucaauuuuagaaucaaaagggaaaggaucaaaagguucaguaacuucccuaagauuaugaaacugugaccagaucuagcccaucuuacuccagguuugauacucuuuccacaauacugagcugccucagaauccucaaaaucaguuuuuauauuccccaaaagaagaaggaaaccaaggaguagcuauauauuucuacuuugugucauuuuugccaucauuauuaucauacugaaggaaauuuuccagaucauuaggacauaauacauguugagagugucucaacacuuauuagugacaguauugacaucugagcauacuccaguuuacuaauacagcaggguaacugggccagauguucuuucuacagaagaauauuggauugauuggaguuaauguaauacucaucauuuaccacugugcuuggcagagagcggauacucaaguaaguuuuguuaaaugaaugaaugaauuuagaaccacacaaugccaagauagaauuaauuuaaagccuuaaacaaaauuuaucuaaagaaauaacuucuauuacugucauagaccaaaggaaucugauucucccuagggucaagaacaggcuaaggauacuaaccaauaggauugccugaaggguucugcacauucuuauuugaagcaugaaaaaagaggguuggagguggagaauuaaccuccugccaugacucuggcucaucuaguccugcuccuugugcuauaaaauaaaugcagacuaauuuccugcccaaaguggucuucuccagcuagcccuuaugaauauugaacuuaggaauugugacaaauauguaucugauauggucauuuguuuuaaauaacacccaccccuuauuuuccguaaauacacacacaaaauggaucgcaucugugugacuaaugguuuauuuguauuauaucaucaucaucauccuaaaauuaacaacccagaaacaaaaaucucuauacagagaucaaauucacacucaauaguauguucugaauauauguucaagagagagucucuaaaucacuguuaguguggccaagagcaggguuuucuuuuuguucuuagaacugcucccauuucugggaacuaaaaccaguuuuauuugccccaccccuuggagccacaaauguuuagaacucuucaacuucgguaaugaggaagaaggagaaagagcugggggaagggcagaagacugguuuaggaggaaaaggaaauaaggagaaaagagaaugggagagugagagaaaauaaaaaaggcaaaagggagagagaggggaagggggucucauauuggucauucccugccccagauuucuuaaaguuugauauguauagaauauaauugaaggagguauacacauauugauguuguuuugauuaucuaugguauugaaucuuuuaaaaucuggucacaaauuuugaugcugagggggauuauucaagggacuaggaugaacuaaauaagaacucaguuguucuuugucauacuacuauuccuuucgucucccagaauccucagggcacugaggguaggucugacaaauaaggccugcugugcgaauauagccuuucugaaauguaccaggaugguuucugcuuagagacacuuagguccagccuguucacacugcaccucagguaucaauucaucuauucaacagauauuuauuguguuauuacuaugagucaggcucuguuuauuguuucaauucuuuacaccaaaguaugaacuggagaggguaccucaguuauaaggagucugagaauauuggcccuuucuaaccuaugugcauaauuaaaaccagcuucauuuguugcuccgagaguguuucuccaagguuuucuaucuucaaaaccaacuaaguuaugaaaguagagagaucugcccuguguuauccaguuaugagauaaaaaaugaauauaagagugcuugucauuauaaaaguuuccuuuuuuauucucucaagccaccagcugccagccaccagcagccagcugccagccuagcuuuuuuuuuuuuuuuuuuuuuuuagcacuuaguauuuagcauuuauuaacagguacucuaagaaugaugaagcauuguuuuuaaucuuaagacuaugaagguuuuucuuaguucuucugcuuuugcaauuguguuugugaaauuugaauacuugcaggcuuuguaugugaauaauucuagcgggggaccugggagauaauuccuacggggaauucuuaaaacugugcucaacuauuaaaaugaaugagcuuucaaaaaaaaaaaaaaaaaaaaaaaaaaaaaaaaaaa

SEQ ID NO: 122 - RNA, 2582 nt, Homo_Sapiens
guugcugggugucccagggccugaggcaggacgguacuccgcugacaccuucccuuucggccuugagguucccagccugguggccccaggacguuccggucgcauggcagagugcuacggacgacgccuaugaagcccuuaguccuucuaguugcgcuuuugcuauggccuucgucugugccggcuuauccgaggucucaauccauugcgcccaggcugguaugcagucauguuguaucuggaauugguggguucuuggucucacugacuucaagaaugaagccgcagacccucgugcaccaugagugccgaggaggaugccagguggcuccggugggugacucagcaguuuaagaccauugcaggagaagauggggagaucagccugcaagaauucaaagcagcucugcaugugaaagaguccuucuuugcagagcgauucuuugcccuauuugacuccgauagaaguggcaccaucacccuccaggagcugcaggaggcacugacccugcucauccauggcagccccauggacaaacucaaauuccucuuccagguguaugacaucgaugugugugcacggcagggggcgucugcagguacagaguggggugcuggggcaggcccgcacugggcuucauccccacucgggacaggcaguggcuccauugacccggaugagcugcgcacugugcugcagucgugucugcgcgagagcgccaucucgcugccugacgagaagcuggaccagcugacgcuggcgcucuucgaaucggccgacgcggacggcaacggggccaucaccuucgaggagcuccgggacgagcugcagcgcuuccccggagucauggagaaccugaccaucagcgcugcccacuggcugacggcccccgccccccgcccacgcccgcgccggccgcgccagcugacccgcgccuacuggcacaaccaccgcagccagcuguucugccuggccaccuaugcaggccuccacgugcugcucuucgggcuggcggccagcgcgcaccgggaccucggcgccagcgucaugguggccaagggcuguggccagugccucaacuucgacugcagcuucaucgcggugcugaugcucagacgcugccucaccuggcugcgggccacguggcuggcucaaguccuaccacuggaccagaacauccaguuccaccagcuuaugggcuacgugguaguggggcugucccucgugcacacuguggcucacacugugaacuuuguacuccaggcucaggcggaggccagcccuuuccaguucugggagcugcugcucaccacgaggccuggcauuggcuggguacacgguucggccuccccgacaggugucgcucugcugcugcugcuccuccucauguucaucugcuccaguuccugcauccgcaggaguggccacuuugagguguucuauuggacucaccuguccuaccuccucguguggcuucugcucaucuuucaugggcccaacuucuggaaguggcugcuggugccuggaaucuuguuuuuccuggagaaggccaucggacuggcagugucccgcauggcagccgugugcaucauggaagucaaccuccuccccuccaaggucacucaucuccucaucaagcggcccccuuuuuuucacuauagaccuggugacuacuuguaucugaacauccccaccauugcucgcuaugaguggcaccccuucaccaucagcagugcuccugagcagaaagacacuaucuggcugcacauucggucccaaggccaguggacaaacaggcuguaugaguccuucaaggcaucagacccacugggccgugguucuaagaggcugucgaggagugugacaaugagaaagagucaaaggucguccaagggcucugagauacuuuuggagaaacacaaauucuguaacaucaagugcuacaucgaugggccuuaugggacccccacccgcaggaucuuugccucugagcaugccgugcucaucggggcaggcaucggcaucacccccuuugcuuccauucugcagaguaucauguacaggcaccagaaaagaaagcauacuugccccagcugccagcacuccuggaucgaagguguccaagacaacaugaagcuccauaagguggacuuuaucuggaucaacagagaccagcggucuuucgagugguuugugagccugcugacuaaacuggagauggaccaggccgaggaggcucaauacggccgcuuccuggagcugcauauguacaugacaucugcacugggcaagaaugacaugaaggccauuggccugcagauggcccuugaccuccuggccaacaaggagaagaaagacuccaucacggggcugcagacgcgcacccagccugggcggccugacuggagcaagguguuccagaaaguggcugcugagaagaagggcaaggugcaggucuucuucuguggcuccccagcucuggccaaggugcugaagggccauugugagaaguucggcuucagauuuuuccaagagaauuucuagccucaccucuccaagcucugccccaaguccacaccau

SEQ ID NO: 123 - RNA, 1587 nt, Homo_Sapiens
cauucuucuucuuccucccagcagcucugccuggaagucccccaaucccugugcuccugcccccagaucgugggcuugggggacagcaagaaagcugcaaaggacucagcuggggcggcuccacaaggaccccacaggcuugagguguugccaggauucuaucccaggggguuuucugggucccccagagcccucucaagcacggggaggcagaaggguccucgcccauuucaggaaucugcagccuggaagccacagccauggcaggcccccgauacccaguuucagugcaaggggcagcccuggugcagaucaagaggcuccaaacguuugccuucucugugcgcuggucagacggcagcgacaccuucgugcgcaggaguugggacgaauucaggcagcucaagacccucaaggagaccuucccgguggaggcgggccugcugcggagaucugaccgcguucucccaaagcuucucgaugcaccacuguugggacgcguggggcgcacgagccgcggccuggcgcgccugcagcuguuggaaaccuauucucggaggcugcuggcgacugcagagcgcguggcacggagcccgacgaucacuggcuucuucgcaccgcaaccccuggaccuggagcccgcgcugccacccggcagccgggugauccugcccaccccagaggagcagccucuuucucgcgcugcgggccgccucuccauccacagucuggaggcucagagccugcgcugccugcagcccuucuguacccaggacacgcgggauaggccuuuucaggcgcaggcccaggagagccuggacgugcugcugcggcaccccucaggcugguggcugguggagaacgaagaccggcagaccgccugguuuccagcgcccuaccuggaggaggcggccccgggccaaggccgggagggaggcccgucccuagggagcagcgguccccaguucugugcuucccgcgccuacgagagcagccgcgcagaugagcuguccgugcccgcgggggcgcgcgugcgcguguuggaaacgucagaccgcggcugguggcuaugcagguacggcgaccgggcgggccuacuccccgcggugcugcugcggccggaagggcugggcgcucuccugagcgggacgggguuccguggaggagacgacccggcgggugaggcccggggcuucccugaacccucccaggccaccgccccuccccccaccgugcccacccgaccuucgccgggcgccauccagagccgcugcugcaccgucacacgcagggcccuggagcggcgcccacggcgccagggccgcccucgagggugcguggacucugugccgcaccccacgacggagcagugagcgcgaggaucccgaugaggggauggaccgcgccaucccagggcuggggaggagcggggagggcggaucucccuggccagcagggaugggagggggccauuugcuguuccucugaguaaagcuuguucugcaugaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 124 - RNA, 1132 nt, Homo_Sapiens
agccauggcaggcccccgauacccaguuucagugcaaggggcagcccuggugcagaucaagaggcuccaaacguuugccuucucugugcgcuggucagacggcagcgacaccuucgugcgcaggaguugggacgaauucaggcagcucaagaagacccucaaggagaccuucccgguggaggcgggccugcugcggagaucugaccgcguucucccaaagcuucucgaugcaccacuguugggacgcguggggcgcacgagccgcggccuggcgcgccugcagcuguuggaaaccuauucucggaggcugcuggcgacugcagagcgcguggcacggagcccgacgaucacuggcuucuucgcaccgcaaccccuggaccuggagcccgcgcugccacccggcagccgggugauccugcccaccccagaggagcagccucuuucucgcgcugcgggccgccucuccauccacagucuggaggcucagagccugcgcugccugcagcccuucuguacccaggacacgcgggauaggccuuuucaggcgcaggcccaggagagccuggacgugcugcugcggcaccccucaggcugguggcugguggagaacgaagaccggcagaccgccugguuuccagcgcccuaccuggaggaggcggccccgggccaaggccgggagggaggcccgucccuagggagcagcgguccccaguucugugcuucccgcgccuacgagagcagccgcgcagaugagcuguccgugcccgcgggggcgcgcgugcgcguguuggaaacgucagaccgcggcugguggcuaugcagguacggcgaccgggcgggccuacuccccgcggugcugcugcggccggaagggcugggcgcucuccugagcgggacgggguuccguggaggagacgacccggcgggugaggcccggggcuucccugaacccucccaggccaccgccccuccccccaccgugcccacccgaccuucgccgggcgccauccagagccgcugcugcaccgucacacgcagggcccuggagcggcgcccacggcgccagggccgcccucgagggugcguggacucugugccgcaccccacgacggagcagugagcgcgaggaucc

SEQ ID NO: 125 - RNA, 1147 nt, Homo_Sapiens
agccauggcaggcccccgauacccaguuucagugcaaggggcagcccuggugcagaucaagaggcuccaaacguuugccuucucugugcgcuggucagacggcagcgacaccuucgugcgcaggaguugggacgaauucaggcagcucaagaagacccucaaggagaccuucccgguggaggcgggccugcugcggagaucugaccgcguucucccaaagcuucucggucaggccagccuggaugcaccacuguugggacgcguggggcgcacgagccgcggccuggcgcgccugcagcuguuggaaaccuauucucggaggcugcuggcgacugcagagcgcguggcacggagcccgacgaucacuggcuucuucgcaccgcaaccccuggaccuggagcccgcgcugccacccggcagccgggugauccugcccaccccagaggagcagccucuuucucgcgcugcgggccgccucuccauccacagucuggaggcucagagccugcgcugccugcagcccuucuguacccaggacacgcgggauaggccuuuucaggcgcaggcccaggagagccuggacgugcugcugcggcaccccucaggcugguggcugguggagaacgaagaccggcagaccgccugguuuccagcgcccuaccuggaggaggcggccccgggccaaggccgggagggaggcccgucccuagggagcagcgguccccaguucugugcuucccgcgccuacgagagcagccgcgcagaugagcuguccgugcccgcgggggcgcgcgugcgcguguuggaaacgucagaccgcggcugguggcuaugcagguacggcgaccgggcgggccuacuccccgcggugcugcugcggccggaagggcugggcgcucuccugagcgggacgggguuccguggaggagacgacccggcgggugaggcccggggcuucccugaacccucccaggccaccgccccuccccccaccgugcccacccgaccuucgccgggcgccauccagagccgcugcugcaccgucacacgcagggcccuggagcggcgcccacggcgccagggccgcccucgagggugcguggacucugugccgcaccccacgacggagcagugagcgcgaggaucc

SEQ ID NO: 126 - RNA, 1409 nt, Homo_Sapiens
cgacuuccucuuuccagugcauuuaaggcgcagccuggaagugccagggagcacuggaggccacccagucaugggggacaccuucauccgucacaucgcccugcugggcuuugagaagcgcuucguacccagccagcacuauguguacauguuccuggugaaauggcaggaccugucggagaagguggucuaccggcgcuucaccgagaucuacgaguuccauaaaaccuuaaaagaaauguucccuauugaggcaggggcgaucaauccagagaacaggaucaucccccaccucccagcucccaagugguuugacgggcagcgggccgccgagaaccgccagggcacacuuaccgaguacugcggcacgcucaugagccugcccaccaagaucucccgcuguccccaccuccucgacuucuucaaggugcgcccugaugaccucaagcuccccacggacaaccagacaaaaaagccagagacauacuugaugcccaaagauggcaagaguaccgcgacagacaucaccggccccaucauccugcagacguaccgcgccauugccaacuacgagaagaccucgggcuccgagauggcucuguccacgggggacgugguggaggucguagagaagagcgagagcgguuggugguucugucagaugaaagcaaagcgaggcuggaucccagcguccuuccucgagccccuggacaguccugacgagacggaagacccugagcccaacuaugcaggugagccauacgucgccaucaaggccuacacugcuguggagggggacgaggugucccugcucgagggugaagcuguugaggucauucacaagcuccuggacggcuggugggucaucaggaaagacgacgucacaggcuacuucccguccauguaccugcaaaagucagggcaagacgugucccaggcccaacgccagaucaagcggggggcgccgccccgcaggucguccauccgcaacgcgcacagcauccaccagcggucgcggaagcgccucagccaggacgccuaucgccgcaacagcguccguuuucugcagcagcgacgccgccaggcgcggccgggaccgcagagccccgggagcccgcucgaggaggagcggcagacgcagcgcucuaaaccgcagccggcggugcccccgcggccgagcgccgaccucauccugaaccgcugcagcgagagcaccaagcggaagcuggcgucugccgucugaggcuggagcgcaguccccagcuagcgucucggcccuugccgccccgugccuguacauacguguucuauagagccuggcgucuggacgccgagggcagccccgaccccuguccagcgcggcucccgccacccucaauaaauguugcuuggaguggaaaaaaaaaaaa

SEQ ID NO: 127 - RNA, 1650 nt, Homo_Sapiens
cgggguugcaccuggcgcuuggcgcccgcaccucugcccgccucggagaccccgcagccccgcgccgccgccuggccccggccccggccccuccgcgggauccuggccccuccucgagcgccgccaccggccgccauggccucucugggggaccuggugcgcgccuggcaccugggcgcgcaggcuguggaucguggggacugggcccgcgccuugcaccucuucucgggcgucccggcgccgcccgccaggcugugcuucaacgcgggcugcgugcaccugcuggccggggaccccgaggccgcgcugcgggcauuugaccaagccgugaccaaggacaccugcauggcgguuggcuucuuccagcgaggaguggccaacuuccagcuggcaagguuccaggaggcucugucugacuucuggcuggcccuggagcagcugaggggccacgcugccaucgacuacacgcagcugggccugcgguucaagcugcaagccugggaggugcuacacaauguggcgucggcacagugccagcuggggcucuggacagaggcggccagcagccuaagggaggccauguccaaguggccggaggggucccugaauggccuggacucagcccuggaccaagugcagagacggggcucacugccgccacggcagguccccaggggcgaggucuuccggccccaccgguggcaccugaagcacuuggagcccguggauuuccugggcaaggccaaggugguggccucugccauccccgacgaccagggcuggggcguccgcccucagcagccacagggaccaggagcgaaccaugaugccaggucccuaaucauggacuccccaagagcuggcacccaccagggcccccucgaugcagagacagaggucggugcugaccgcugcacgucgacugccuaccaggagcagaggccccagguggagcaaguuggcaaacaggcuccucucuccccagggcugccggcaaugggggggccuggccccggccccugugaggaccccgcgggugcugggggagcaggugcagggggcuccgagccccuggugacugucaccgugcagugcgccuucacaguggcccugagggcacgaagaggagccgaccuguccagccugcgggcacugcugggccaagcccucccucaccaggcccagcuugggcaacucaguuaccuagccccaggugaggacgggcacuggguccccauccccgaggaggagucgcugcagagggccuggcaggacgcagcugccugccccagggggcugcagcugcagugcaggggagccgggggucggccgguccucuaccaggugguggcccagcacagcuacuccgcccaggggccagaggaccugggcuuccgacagggggacacgguggacguccugugugaagagcccgaugucccccuugcaguggaccaggcauggcuggagggccacugugacggccgcaucggcaucuuccccaagugcuucgugguccccgccggcccucggaugucaggagcccccggccgccugccccgaucccagcagggagaucagcccuaaugaugcuguguccaugaugcuuuuaauaaaaacaacccccacugcaaaaaaaaaaaaaaaaaa

SEQ ID NO: 128 - RNA, 2429 nt, Homo_Sapiens
acacuccaccccuacucgcccucucucucucugcuucuuuccuuuucucucucaugguaggguuaugagucaguugccaaaagguggggacauuuccugaugcauuugcaacacugagaaguuaucuuaagggaggcugggccccauucuacucaucuggcccagaaagugaacaccuugggggccacuaaggcagcccugcuaggggagacgcuccaaccugucuucucucugucuccuggcagcucucuuggccuccuaguuucuaccuaaucaugucccugguggaggccaucagccucuggaaugaaggggugcuggcagcggacaagaaggacuggaagggagcccuggaugccuucagugccguccaggacccccacucccggauuugcuucaacauuggcugcauguacacuauccugaagaacaugacugaagcagagaaggccuuuaccagaagcauuaaccgagacaagcacuuggcaguggcuuacuuccaacgagggaugcucuacuaccagacagagaaauaugauuuggcuaucaaagaccuuaaagaagccuugauucagcuucgagggaaccagcugauagacuauaagauccuggggcuccaguucaagcuguuugccugugagguguuauauaacauugcuuucauguaugccaagaaggaggaauggaaaaaagcugaagaacaguuagcauuggccacgagcaugaagucugagcccagacauuccaaaaucgacaaggcgauggagugugucuggaagcagaagcuauaugagccaguggugaucccugugggcaagcuguuucgaccaaaugagagacaaguggcucagcuggccaagaaggauuaccuaggcaaggcgacggucguggcaucugugguggaucaagacaguuucucuggguuugccccucugcaaccacaggcagcugagccuccacccagaccgaaaaccccagagaucuucagggcucuggaaggggaggcucaccgugugcuauuuggguuugugccugagacaaaagaagagcuccaggucaugccagggaacauugucuuugucuugaagaagggcaaugauaacugggccacggucauguucaacgggcagaaggggcuuguucccugcaacuaccuugaaccaguugagcugcggauccacccucagcagcagccccaggaggaaagcucuccgcaguccgacaucccagcuccuccuaguuccaaagccccuggaagaccccagcugucaccaggccagaaacaaaaagaagagccuaaggaagugaagcucaguguucccaugcccuacacacucaaggugcacuacaaguacacgguagucaugaagacucagcccgggcuccccuacagccagguccgggacauggugucuaagaaacuggagcuccggcuggaacacacuaagcugagcuaucggccucgggacagcaaugagcuggugccccuuucagaagacagcaugaaggaugccuggggccaggugaaaaacuacugccugacucuguggugugagaacacagugggugaccaaggcuuuccagaugaacccaaggaaagugaaaaagcugaugcuaauaaccagacaacagaaccucagcuuaagaaaggcagccaaguggaggcacucuucaguuaugaggcuacccaaccagaggaccuggaguuucaggaaggggauauaauccugguguuaucaaaggugaaugaagaauggcuggaaggggagugcaaagggaaggugggcauuuuccccaaaguuuuuguugaagacugcgcaacuacagauuuggaaagcacucggagagaagucuaggauguuucacaaacuacaaagcugaagaaaaugaagcccuauuacuuguuuguaagauuuagcacccuucugcuguauacuguacugagacauuacaguuuggaaguguuaacuauuuauucccuguuaaaauuuaaccuacuagacaaugaugugaguacccaggaugauuuccuggggcacagugggugaggagauggggacaggugaauggaggaguuaggggagaggaaaaguggauggaagugucuggaaagggcacgagagagucuuccagguacugauccuguuucuugcucugagugcuagcuagccagcuguguucacacuguaaacauucaucaagcuguacauuuggugcacuuuucugugucauaccacaauaaaaaaaaaccuagcaucuuacaaaaacaagacacccaaguccaggcccaaggaguaaguacaaauauuccuguuucugaaccauuacuguaauuggcucuuaaggcuugaaguaaccuuauagguuacucauaaggcauauacaaauaaacuuguuuguuuucuuuuuucaaaaaaaaaaaaaaaaaa

SEQ ID NO: 129 - RNA, 2256 nt, Homo_Sapiens
acucuaggucacggguuucauuugggaccaguagccuagucuuucagccuucaggcuguuuuuggcuugaagcucucuuggccuccuaguuucuaccuaaucaugucccugguggaggccaucagccucuggaaugaaggggugcuggcagcggacaagaaggacuggaagggagcccuggaugccuucagugccguccaggacccccacucccggauuugcuucaacauuggcugcauguacacuauccugaagaacaugacugaagcagagaaggccuuuaccagaagcauuaaccgagacaagcacuuggcaguggcuuacuuccaacgagggaugcucuacuaccagacagagaaauaugauuuggcuaucaaagaccuuaaagaagccuugauucagcuucgagggaaccagcugauagacuauaagauccuggggcuccaguucaagcuguuugccugugagguguuauauaacauugcuuucauguaugccaagaaggaggaauggaaaaaagcugaagaacaguuagcauuggccacgagcaugaagucugagcccagacauuccaaaaucgacaaggcgauggagugugucuggaagcagaagcuauaugagccaguggugaucccugugggcaagcuguuucgaccaaaugagagacaaguggcucagcuggccaagaaggauuaccuaggcaaggcgacggucguggcaucugugguggaucaagacaguuucucuggguuugccccucugcaaccacaggcagcugagccuccacccagaccgaaaaccccagagaucuucagggcucuggaaggggaggcucaccgugugcuauuuggguuugugccugagacaaaagaagagcuccaggucaugccagggaacauugucuuugucuugaagaagggcaaugauaacugggccacggucauguucaacgggcagaaggggcuuguucccugcaacuaccuugaaccaguugagcugcggauccacccucagcagcagccccaggaggaaagcucuccgcaguccgacaucccagcuccuccuaguuccaaagccccuggaagaccccagcugucaccaggccagaaacaaaaagaagagccuaaggaagugaagcucaguguucccaugcccuacacacucaaggugcacuacaaguacacgguagucaugaagacucagcccgggcuccccuacagccagguccgggacauggugucuaagaaacuggagcuccggcuggaacacacuaagcugagcuaucggccucgggacagcaaugagcuggugccccuuucagaagacagcaugaaggaugccuggggccaggugaaaaacuacugccugacucuguggugugagaacacagugggugaccaaggcuuuccagaugaacccaaggaaagugaaaaagcugaugcuaauaaccagacaacagaaccucagcuuaagaaaggcagccaaguggaggcacucuucaguuaugaggcuacccaaccagaggaccuggaguuucaggaaggggauauaauccugguguuaucaaaggugaaugaagaauggcuggaaggggagugcaaagggaaggugggcauuuuccccaaaguuuuuguugaagacugcgcaacuacagauuuggaaagcacucggagagaagucuaggauguuucacaaacuacaaagcugaagaaaaugaagcccuauuacuuguuuguaagauuuagcacccuucugcuguauacuguacugagacauuacaguuuggaaguguuaacuauuuauucccuguuaaaauuuaaccuacuagacaaugaugugaguacccaggaugauuuccuggggcacagugggugaggagauggggacaggugaauggaggaguuaggggagaggaaaaguggauggaagugucuggaaagggcacgagagagucuuccagguacugauccuguuucuugcucugagugcuagcuagccagcuguguucacacuguaaacauucaucaagcuguacauuuggugcacuuuucugugucauaccacaauaaaaaaaaaccuagcaucuuacaaaaacaagacacccaaguccaggcccaaggaguaaguacaaauauuccuguuucugaaccauuacuguaauuggcucuuaaggcuugaaguaaccuuauagguuacucauaaggcauauacaaauaaacuuguuuguuuucuuuuuucaaaaaaaaaaaaaaaaaa

SEQ ID NO: 130 - RNA, 2586 nt, Homo_Sapiens
gauugggguuuuccccucccaugugcucaagacuggcgcuaaaaguuuugagcuucucaaaagucuagagccaccguccagggagcagguagcugcugggcuccggggacacuuugcguucgggcugggagcgugcuuuccacgacggugacacgcuucccuggauuggcagccagacugccuuccgggucacugccauggaggagccgcagucagauccuagcgucgagcccccucugagucaggaaacauuuucagaccuauggaaacuacuuccugaaaacaacguucugucccccuugccgucccaagcaauggaugauuugaugcuguccccggacgauauugaacaaugguucacugaagacccagguccagaugaagcucccagaaugccagaggcugcuccccccguggccccugcaccagcagcuccuacaccggcggccccugcaccagcccccuccuggccccugucaucuucugucccuucccagaaaaccuaccagggcagcuacgguuuccgucugggcuucuugcauucugggacagccaagucugugacuugcacguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 131 - RNA, 2583 nt, Homo_Sapiens
gauugggguuuuccccucccaugugcucaagacuggcgcuaaaaguuuugagcuucucaaaagucuagagccaccguccagggagcagguagcugcugggcuccggggacacuuugcguucgggcugggagcgugcuuuccacgacggugacacgcuucccuggauuggccagacugccuuccgggucacugccauggaggagccgcagucagauccuagcgucgagcccccucugagucaggaaacauuuucagaccuauggaaacuacuuccugaaaacaacguucugucccccuugccgucccaagcaauggaugauuugaugcuguccccggacgauauugaacaaugguucacugaagacccagguccagaugaagcucccagaaugccagaggcugcuccccccguggccccugcaccagcagcuccuacaccggcggccccugcaccagcccccuccuggccccugucaucuucugucccuucccagaaaaccuaccagggcagcuacgguuuccgucugggcuucuugcauucugggacagccaagucugugacuugcacguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 132 - RNA, 2719 nt, Homo_Sapiens
gauugggguuuuccccucccaugugcucaagacuggcgcuaaaaguuuugagcuucucaaaagucuagagccaccguccagggagcagguagcugcugggcuccggggacacuuugcguucgggcugggagcgugcuuuccacgacggugacacgcuucccuggauuggcagccagacugccuuccgggucacugccauggaggagccgcagucagauccuagcgucgagcccccucugagucaggaaacauuuucagaccuauggaaacuacuuccugaaaacaacguucugucccccuugccgucccaagcaauggaugauuugaugcuguccccggacgauauugaacaaugguucacugaagacccagguccagaugaagcucccagaaugccagaggcugcuccccccguggccccugcaccagcagcuccuacaccggcggccccugcaccagcccccuccuggccccugucaucuucugucccuucccagaaaaccuaccagggcagcuacgguuuccgucugggcuucuugcauucugggacagccaagucugugacuugcacguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucaggaccagaccagcuuucaaaaagaaaauuguuaaagagagcaugaaaaugguucuaugacuuugccugauacagaugcuacuugacuuacgaugguguuacuuccugauaaacucgucguaaguugaaaauauuauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 133 - RNA, 2646 nt, Homo_Sapiens
gauugggguuuuccccucccaugugcucaagacuggcgcuaaaaguuuugagcuucucaaaagucuagagccaccguccagggagcagguagcugcugggcuccggggacacuuugcguucgggcugggagcgugcuuuccacgacggugacacgcuucccuggauuggcagccagacugccuuccgggucacugccauggaggagccgcagucagauccuagcgucgagcccccucugagucaggaaacauuuucagaccuauggaaacuacuuccugaaaacaacguucugucccccuugccgucccaagcaauggaugauuugaugcuguccccggacgauauugaacaaugguucacugaagacccagguccagaugaagcucccagaaugccagaggcugcuccccccguggccccugcaccagcagcuccuacaccggcggccccugcaccagcccccuccuggccccugucaucuucugucccuucccagaaaaccuaccagggcagcuacgguuuccgucugggcuucuugcauucugggacagccaagucugugacuugcacguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagaugcuacuugacuuacgaugguguuacuuccugauaaacucgucguaaguugaaaauauuauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 134 - RNA, 2271 nt, Homo_Sapiens
ugaggccaggagauggaggcugcagugagcugugaucacaccacugugcuccagccugagugacagagcaagacccuaucucaaaaaaaaaaaaaaaaaagaaaagcuccugagguguagacgccaacucucucuagcucgcuaguggguugcaggaggugcuuacgcauguuuguuucuuugcugccgucuuccaguugcuuuaucuguucacuugugcccugacuuucaacucugucuccuuccucuuccuacaguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 135 - RNA, 2404 nt, Homo_Sapiens
ugaggccaggagauggaggcugcagugagcugugaucacaccacugugcuccagccugagugacagagcaagacccuaucucaaaaaaaaaaaaaaaaaagaaaagcuccugagguguagacgccaacucucucuagcucgcuaguggguugcaggaggugcuuacgcauguuuguuucuuugcugccgucuuccaguugcuuuaucuguucacuugugcccugacuuucaacucugucuccuuccucuuccuacaguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucaggaccagaccagcuuucaaaaagaaaauuguuaaagagagcaugaaaaugguucuaugacuuugccugauacagaugcuacuugacuuacgaugguguuacuuccugauaaacucgucguaaguugaaaauauuauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 136 - RNA, 2331 nt, Homo_Sapiens
ugaggccaggagauggaggcugcagugagcugugaucacaccacugugcuccagccugagugacagagcaagacccuaucucaaaaaaaaaaaaaaaaaagaaaagcuccugagguguagacgccaacucucucuagcucgcuaguggguugcaggaggugcuuacgcauguuuguuucuuugcugccgucuuccaguugcuuuaucuguucacuugugcccugacuuucaacucugucuccuuccucuuccuacaguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagaugcuacuugacuuacgaugguguuacuuccugauaaacucgucguaaguugaaaauauuauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 137 - RNA, 2550 nt, Homo_Sapiens
cguggaucccgagaaagaggcgcaggacgaggaggcagaacccgacuggcgcguagagcagcagcacgagcaguaggaagcagucacccggaagccugggggcgagaggcgaaguggucaggcgccgaaggccgagagcacgcggggaucggucucuucccgccgggucucuuaccggugcgagucaaagagccgcuccggccccggcccugagggaagcuccauaacugcugcuucaggagcgcccggccgucgccgccgccgccauuuucgcgcccggccgcaggggcucuugggaaggcggagucuuugggcauccgcccggggugaggggacccgaaguccugaggcgcgccggaagggcuagcggucccagcauaccccgcggccccuugggccgucucacaacucgcguccggcggagaccacaauucccggcauucguggggcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaggagccucuccccacgcugccucugggacgcucagcugauguccggcaaggggaguuuguuguugccaugggaagucccuuugcacugcagaacacgaucacauccggcauuguuagcucugcucagcguccagccagagaccugggacucccccaaaccaauguggaauacauucaaacugaugcagcuauugauuuuggaaacucuggagguccccugguuaaccuggauggggaggugauuggagugaacaccaugaaggucacagcuggaaucuccuuugccaucccuucugaucgucuucgagaguuucugcaucguggggaaaagaagaauuccuccuccggaaucagugggucccagcggcgcuacauuggggugaugaugcugacccugagucccagcauccuugcugaacuacagcuucgagaaccaagcuuucccgauguucagcaugguguacucauccauaaagucauccugggcuccccugcacaccgggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaaugaggugggagggcuggaucuuuucccccaccaaaaggcuagagguaaagcuguaucccccuaaacuuaggggagauacuggagcugaccauccugaccuccuauuaaagaaaaugagcugcugccaucuuuugugggcaguuagucaggugcugcucuuugugguguggugggcucuggucuguucugcucggugcugggccugggagcaaagauucccaugcuuggcuacagauacugacagcuggccucugaaggagggugaaaacuucugcuugacaguuccacauccauagugcauggucugaugagugcgguugcugacauggguuucuugguaagcuccugagguaauggcagccuc

SEQ ID NO: 138 - RNA, 2259 nt, Homo_Sapiens
cguggaucccgagaaagaggcgcaggacgaggaggcagaacccgacuggcgcguagagcagcagcacgagcaguaggaagcagucacccggaagccugggggcgagaggcgaaguggucaggcgccgaaggccgagagcacgcggggaucggucucuucccgccgggucucuuaccggugcgagucaaagagccgcuccggccccggcccugagggaagcuccauaacugcugcuucaggagcgcccggccgucgccgccgccgccauuuucgcgcccggccgcaggggcucuugggaaggcggagucuuugggcauccgcccggggugaggggacccgaaguccugaggcgcgccggaagggcuagcggucccagcauaccccgcggccccuugggccgucucacaacucgcguccggcggagaccacaauucccggcauucguggggcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaguuuggaaacucuggagguccccugguuaaccuggauggggaggugauuggagugaacaccaugaaggucacagcuggaaucuccuuugccaucccuucugaucgucuucgagaguuucugcaucguggggaaaagaagaauuccuccuccggaaucagugggucccagcggcgcuacauuggggugaugaugcugacccugagucccagggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaaugaggugggagggcuggaucuuuucccccaccaaaaggcuagagguaaagcuguaucccccuaaacuuaggggagauacuggagcugaccauccugaccuccuauuaaagaaaaugagcugcugccaucuuuugugggcaguuagucaggugcugcucuuugugguguggugggcucuggucuguucugcucggugcugggccugggagcaaagauucccaugcuuggcuacagauacugacagcuggccucugaaggagggugaaaacuucugcuugacaguuccacauccauagugcauggucugaugagugcgguugcugacauggguuucuugguaagcuccugagguaauggcagccuc

SEQ ID NO: 139 - RNA, 2606 nt, Homo_Sapiens
cuuuccgcccucuccccgccuccuuuucgggcgucccgaggccgcuccccaaccgacaaccaagaccccgcaggccacgcagcccuggagccgaggccccccgacggcggaggcgcccgcggguccccuacagccaaggucccugagugccagagguggugguguugcuuaucuucuggaaccccaugcagccagaucccaggccuagcggggcuggggccugcugccgauuccugccccugcagucacagugcccugagggggcaggggacgcggugauguacgccuccacugagugcaaggcggaggugacgcccucccagcauggcaaccgcaccuucagcuacacccuggaggaucauaccaagcaggccuuuggcaucaugaacgagcugcggcucagccagcagcugugugacgucacacugcaggucaaguaccaggaugcaccggccgcccaguucauggcccacaagguggugcuggccucauccagcccugucuucaaggccauguucaccaacgggcugcgggagcagggcauggaggugguguccauugaggguauccaccccaaggucauggagcgccucauugaauucgccuacacggccuccaucuccaugggcgagaaguguguccuccacgucaugaacggugcugucauguaccagaucgacagcguuguccgugccugcagugacuuccuggugcagcagcuggaccccagcaaugccaucggcaucgccaacuucgcugagcagauuggcuguguggaguugcaccagcgugcccgggaguacaucuacaugcauuuuggggagguggccaagcaagaggaguucuucaaccugucccacugccaacuggugacccucaucagccgggacgaccugaacgugcgcugcgaguccgaggucuuccacgccugcaucaacugggucaaguacgacugcgaacagcgacgguucuacguccaggcgcugcugcgggccgugcgcugccacucguugacgccgaacuuccugcagaugcagcugcagaagugcgagauccugcaguccgacucccgcugcaaggacuaccuggucaagaucuucgaggagcucacccugcacaagcccacgcaggugaugcccugccgggcgcccaaggugggccgccugaucuacaccgcgggcggcuacuuccgacagucgcucagcuaccuggaggcuuacaaccccagugacggcaccuggcuccgguuggcggaccugcaggugccgcggagcggccuggccggcugcguggugggcgggcuguuguacgccgugggcggcaggaacaacucgcccgacggcaacaccgacuccagcgcccuggacuguuacaaccccaugaccaaucaguggucgcccugcgcccccaugagcgugccccguaaccgcaucggggugggggucaucgauggccacaucuaugccgucggcggcucccacggcugcauccaccacaacaguguggagagguaugagccagagcgggaugaguggcacuugguggccccaaugcugacacgaaggaucggggugggcguggcuguccucaaucgucuccuuuaugccguggggggcuuugacgggacaaaccgccuuaauucagcugaguguuacuacccagagaggaacgaguggcgaaugaucacagcaaugaacaccauccgaagcggggcaggcgucugcguccugcacaacuguaucuaugcugcugggggcuaugauggucaggaccagcugaacagcguggagcgcuacgauguggaaacagagacguggacuuucguagcccccaugaagcaccggcgaagugcccuggggaucacuguccaccaggggagaaucuacguccuuggaggcuaugauggucacacguuccuggacaguguggaguguuacgacccagauacagacaccuggagcgaggugacccgaaugacaucgggccggaguggggugggcguggcugucaccauggagcccugccggaagcagauugaccagcagaacuguaccuguugaggcacuuuuguuucuugggcaaaaauacaguccaauggggaguaucauuguuuuuguacaaaaaccgggacuaaaagaaaagacagcacugcaaauaacccaucuuccgggaagggaggccaggaugccucaguguuaaaaugacaucucaaaagaaguccaaagcgggaaucaugugccccucagcggagccccgggaguguccaagacagccuggcugggaaaggggguguggaaagagcaggcuuccaggagagaggcccccaaacccucuggccggguaauaggccugggucccacucacccaugccggcagcugucaccaugugauuuauucuuggauaccugggagggggccaaugggggccucagggggaggcccccucuggaaaugugguucccagggaugggccuguacauagaagccaccggauggcacuuccccaccggauggacaguuauuuuguugauaaguaacccuguaauuuuccaaggaaaauaaagaacagacuaacuagugucuuucacccugaaaaaaaaaaaaaa

SEQ ID NO: 140 - RNA, 2577 nt, Homo_Sapiens
ucugcuuagucauggugaccugcgcgcgcuccgcgccucccccacgcgcagcgauggaggcgccggggcucgggcgguggaggcggagccggagcgcggccauggcggggucccugagugccagagguggugguguugcuuaucuucuggaaccccaugcagccagaucccaggccuagcggggcuggggccugcugccgauuccugccccugcagucacagugcccugagggggcaggggacgcggugauguacgccuccacugagugcaaggcggaggugacgcccucccagcauggcaaccgcaccuucagcuacacccuggaggaucauaccaagcaggccuuuggcaucaugaacgagcugcggcucagccagcagcugugugacgucacacugcaggucaaguaccaggaugcaccggccgcccaguucauggcccacaagguggugcuggccucauccagcccugucuucaaggccauguucaccaacgggcugcgggagcagggcauggaggugguguccauugaggguauccaccccaaggucauggagcgccucauugaauucgccuacacggccuccaucuccaugggcgagaaguguguccuccacgucaugaacggugcugucauguaccagaucgacagcguuguccgugccugcagugacuuccuggugcagcagcuggaccccagcaaugccaucggcaucgccaacuucgcugagcagauuggcuguguggaguugcaccagcgugcccgggaguacaucuacaugcauuuuggggagguggccaagcaagaggaguucuucaaccugucccacugccaacuggugacccucaucagccgggacgaccugaacgugcgcugcgaguccgaggucuuccacgccugcaucaacugggucaaguacgacugcgaacagcgacgguucuacguccaggcgcugcugcgggccgugcgcugccacucguugacgccgaacuuccugcagaugcagcugcagaagugcgagauccugcaguccgacucccgcugcaaggacuaccuggucaagaucuucgaggagcucacccugcacaagcccacgcaggugaugcccugccgggcgcccaaggugggccgccugaucuacaccgcgggcggcuacuuccgacagucgcucagcuaccuggaggcuuacaaccccagugacggcaccuggcuccgguuggcggaccugcaggugccgcggagcggccuggccggcugcguggugggcgggcuguuguacgccgugggcggcaggaacaacucgcccgacggcaacaccgacuccagcgcccuggacuguuacaaccccaugaccaaucaguggucgcccugcgcccccaugagcgugccccguaaccgcaucggggugggggucaucgauggccacaucuaugccgucggcggcucccacggcugcauccaccacaacaguguggagagguaugagccagagcgggaugaguggcacuugguggccccaaugcugacacgaaggaucggggugggcguggcuguccucaaucgucuccuuuaugccguggggggcuuugacgggacaaaccgccuuaauucagcugaguguuacuacccagagaggaacgaguggcgaaugaucacagcaaugaacaccauccgaagcggggcaggcgucugcguccugcacaacuguaucuaugcugcugggggcuaugauggucaggaccagcugaacagcguggagcgcuacgauguggaaacagagacguggacuuucguagcccccaugaagcaccggcgaagugcccuggggaucacuguccaccaggggagaaucuacguccuuggaggcuaugauggucacacguuccuggacaguguggaguguuacgacccagauacagacaccuggagcgaggugacccgaaugacaucgggccggaguggggugggcguggcugucaccauggagcccugccggaagcagauugaccagcagaacuguaccuguugaggcacuuuuguuucuugggcaaaaauacaguccaauggggaguaucauuguuuuuguacaaaaaccgggacuaaaagaaaagacagcacugcaaauaacccaucuuccgggaagggaggccaggaugccucaguguuaaaaugacaucucaaaagaaguccaaagcgggaaucaugugccccucagcggagccccgggaguguccaagacagccuggcugggaaaggggguguggaaagagcaggcuuccaggagagaggcccccaaacccucuggccggguaauaggccugggucccacucacccaugccggcagcugucaccaugugauuuauucuuggauaccugggagggggccaaugggggccucagggggaggcccccucuggaaaugugguucccagggaugggccuguacauagaagccaccggauggcacuuccccaccggauggacaguuauuuuguugauaaguaacccuguaauuuuccaaggaaaauaaagaacagacuaacuagugucuuucacccugaaaaaaaaaaaaaa

SEQ ID NO: 141 - RNA, 3493 nt, Homo_Sapiens
agagaagaggcuccacguugggcggggauggggccugaaacugucugggucugagcuggggagcggaagccacuugucccucucccuccccaggacuucugugacuccugggccacagagguccaaccaggcuaagggccuggggauacccccugccuggcccccuugcccaaacuggcaggggggccaggcugggcagcagccccucuuucaccucaacuauggaucuccugccccccaagcccaaguacaauccacuccggaaugagucucugucaucgcuggaggaaggggcuucuggguccacccccccggaggagcugccuuccccaucagcuucaucccuggggcccauccugccuccucugccuggggacgauagucccacuacccugugcuccuucuucccccggaugagcaaccugaggcuggccaacccggcuggggggcgcccagggucuaagggggagccaggaagggcagcugaugauggggaggggaucguaggggcagccaugccagacucaggcccccuaccccuccuccaggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgcgugccuccaccuccccagucgguguccauggcugagcagcuccgaggggagcccugguuccaugggaagcugagccggcgggaggcugaggcacugcugcagcucaauggggacuuccugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacugugaucugcccuagcgcucucuuccagaagaugcccuccaauccuuuccacccuauucccuaacucucgggaccucguuugggaguguucugugggcuuggccuugugucagagcugggaguagcauggacucuggguuucauauccagcugagugagaggguuugagucaaaagccugggugagaauccugccucuccccaaacauuaaucaccaaaguauuaauguacagaguggccccucaccugggccuuuccugugccaaccugaugccccuuccccaagaaggugagugcuugucauggaaaauguccuguggugacaggcccaguggaacagucacccuucugggcaagggggaacaaaucacaccucugggcuucaggguaucccagaccccucucaacacccgccccccccauguuuaaacuuugugccuuugaccaucucuuaggucuaaugauauuuuaugcaaacaguucuuggaccccugaauucaaugacagggaugccaacaccuucuuggcuucugggaccuguguucuugcugagcacccucuccgguuuggguugggauaacagaggcaggaguggcagcuguccccucucccuggggauaugcaacccuuagagauugccccagagccccacucccggccaggcgggagauggaccccucccuugcucagugccuccuggccggggccccucaccccaaggggucuguauauacauuucauaaggccugcccucccauguugcaugccuauguacucuacgccaaagugcagcccuuccuccugaagccucugcccugccucccuuucugggagggcggggugggggugacugaauuugggccucuuguacaguuaacucucccagguggauuuuguggaggugagaaaaggggcauugagacuauaaagcaguagacaauccccacauaccaucuguagaguuggaacugcauucuuuuaaaguuuuauaugcauauauuuuagggcuguagacuuacuuuccuauuuucuuuuccauugcuuauucuugagcacaaaaugauaaucaauuauuacauuuauacaucaccuuuuugacuuuuccaagcccuuuuacagcucuuggcauuuuccucgccuaggccugugagguaacugggaucgcaccuuuuauaccagagaccugaggcagaugaaauuuauuuccaucuaggacuagaaaaacuugggucucuuaccgcgagacugagaggcagaagucagcccgaaugccugucaguuucauggaggggaaacgcaaaaccugcaguuccugaguaccuucuacaggcccggcccagccuaggcccgggguggccacaccacagcaagccggcccccccucuuuuggccuuguggauaagggagaguugaccguuuucauccuggccuccuuuugcuguuuggauguuuccacgggucucacuuauaccaaagggaaaacucuucauuaaaguccguauuucuucuaaaaaaaaaaaaaaaa

SEQ ID NO: 142 - RNA, 3195 nt, Homo_Sapiens
acugccuuugugcgcgaucucgcgcugccauuggcuaacucgggaaagugggaagcgugaaggagggacccugagguagagggucagggguuagugaggccggaagugaguguaauaaaguuucuccagggaggcagggcccggggagaaaguuggagcgguaaccuaagcuggcaguggcgugauccggcaccaaaucggcccgcggugcggugcggagacuccaugaggcccuggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccagcaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgcgugccuccaccuccccagucgguguccauggcugagcagcuccgaggggagcccugguuccaugggaagcugagccggcgggaggcugaggcacugcugcagcucaauggggacuuccugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacugugaucugcccuagcgcucucuuccagaagaugcccuccaauccuuuccacccuauucccuaacucucgggaccucguuugggaguguucugugggcuuggccuugugucagagcugggaguagcauggacucuggguuucauauccagcugagugagaggguuugagucaaaagccugggugagaauccugccucuccccaaacauuaaucaccaaaguauuaauguacagaguggccccucaccugggccuuuccugugccaaccugaugccccuuccccaagaaggugagugcuugucauggaaaauguccuguggugacaggcccaguggaacagucacccuucugggcaagggggaacaaaucacaccucugggcuucaggguaucccagaccccucucaacacccgccccccccauguuuaaacuuugugccuuugaccaucucuuaggucuaaugauauuuuaugcaaacaguucuuggaccccugaauucaaugacagggaugccaacaccuucuuggcuucugggaccuguguucuugcugagcacccucuccgguuuggguugggauaacagaggcaggaguggcagcuguccccucucccuggggauaugcaacccuuagagauugccccagagccccacucccggccaggcgggagauggaccccucccuugcucagugccuccuggccggggccccucaccccaaggggucuguauauacauuucauaaggccugcccucccauguugcaugccuauguacucuacgccaaagugcagcccuuccuccugaagccucugcccugccucccuuucugggagggcggggugggggugacugaauuugggccucuuguacaguuaacucucccagguggauuuuguggaggugagaaaaggggcauugagacuauaaagcaguagacaauccccacauaccaucuguagaguuggaacugcauucuuuuaaaguuuuauaugcauauauuuuagggcuguagacuuacuuuccuauuuucuuuuccauugcuuauucuugagcacaaaaugauaaucaauuauuacauuuauacaucaccuuuuugacuuuuccaagcccuuuuacagcucuuggcauuuuccucgccuaggccugugagguaacugggaucgcaccuuuuauaccagagaccugaggcagaugaaauuuauuuccaucuaggacuagaaaaacuugggucucuuaccgcgagacugagaggcagaagucagcccgaaugccugucaguuucauggaggggaaacgcaaaaccugcaguuccugaguaccuucuacaggcccggcccagccuaggcccgggguggccacaccacagcaagccggcccccccucuuuuggccuuguggauaagggagaguugaccguuuucauccuggccuccuuuugcuguuuggauguuuccacgggucucacuuauaccaaagggaaaacucuucauuaaaguccguauuucuucuaaaaaaaaaaaaaaaaaaaaaaaaaaa

SEQ ID NO: 143 - RNA, 3496 nt, Homo_Sapiens
agagaagaggcuccacguugggcggggauggggccugaaacugucugggucugagcuggggagcggaagccacuugucccucucccuccccaggacuucugugacuccugggccacagagguccaaccaggcuaagggccuggggauacccccugccuggcccccuugcccaaacuggcaggggggccaggcugggcagcagccccucuuucaccucaacuauggaucuccugccccccaagcccaaguacaauccacuccggaaugagucucugucaucgcuggaggaaggggcuucuggguccacccccccggaggagcugccuuccccaucagcuucaucccuggggcccauccugccuccucugccuggggacgauagucccacuacccugugcuccuucuucccccggaugagcaaccugaggcuggccaacccggcuggggggcgcccagggucuaagggggagccaggaagggcagcugaugauggggaggggaucguaggggcagccaugccagacucaggcccccuaccccuccuccaggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccagcaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgcgugccuccaccuccccagucgguguccauggcugagcagcuccgaggggagcccugguuccaugggaagcugagccggcgggaggcugaggcacugcugcagcucaauggggacuuccugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacugugaucugcccuagcgcucucuuccagaagaugcccuccaauccuuuccacccuauucccuaacucucgggaccucguuugggaguguucugugggcuuggccuugugucagagcugggaguagcauggacucuggguuucauauccagcugagugagaggguuugagucaaaagccugggugagaauccugccucuccccaaacauuaaucaccaaaguauuaauguacagaguggccccucaccugggccuuuccugugccaaccugaugccccuuccccaagaaggugagugcuugucauggaaaauguccuguggugacaggcccaguggaacagucacccuucugggcaagggggaacaaaucacaccucugggcuucaggguaucccagaccccucucaacacccgccccccccauguuuaaacuuugugccuuugaccaucucuuaggucuaaugauauuuuaugcaaacaguucuuggaccccugaauucaaugacagggaugccaacaccuucuuggcuucugggaccuguguucuugcugagcacccucuccgguuuggguugggauaacagaggcaggaguggcagcuguccccucucccuggggauaugcaacccuuagagauugccccagagccccacucccggccaggcgggagauggaccccucccuugcucagugccuccuggccggggccccucaccccaaggggucuguauauacauuucauaaggccugcccucccauguugcaugccuauguacucuacgccaaagugcagcccuuccuccugaagccucugcccugccucccuuucugggagggcggggugggggugacugaauuugggccucuuguacaguuaacucucccagguggauuuuguggaggugagaaaaggggcauugagacuauaaagcaguagacaauccccacauaccaucuguagaguuggaacugcauucuuuuaaaguuuuauaugcauauauuuuagggcuguagacuuacuuuccuauuuucuuuuccauugcuuauucuugagcacaaaaugauaaucaauuauuacauuuauacaucaccuuuuugacuuuuccaagcccuuuuacagcucuuggcauuuuccucgccuaggccugugagguaacugggaucgcaccuuuuauaccagagaccugaggcagaugaaauuuauuuccaucuaggacuagaaaaacuugggucucuuaccgcgagacugagaggcagaagucagcccgaaugccugucaguuucauggaggggaaacgcaaaaccugcaguuccugaguaccuucuacaggcccggcccagccuaggcccgggguggccacaccacagcaagccggcccccccucuuuuggccuuguggauaagggagaguugaccguuuucauccuggccuccuuuugcuguuuggauguuuccacgggucucacuuauaccaaagggaaaacucuucauuaaaguccguauuucuucuaaaaaaaaaaaaaaaa

SEQ ID NO: 144 - RNA, 3192 nt, Homo_Sapiens
acugccuuugugcgcgaucucgcgcugccauuggcuaacucgggaaagugggaagcgugaaggagggacccugagguagagggucagggguuagugaggccggaagugaguguaauaaaguuucuccagggaggcagggcccggggagaaaguuggagcgguaaccuaagcuggcaguggcgugauccggcaccaaaucggcccgcggugcggugcggagacuccaugaggcccuggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgcgugccuccaccuccccagucgguguccauggcugagcagcuccgaggggagcccugguuccaugggaagcugagccggcgggaggcugaggcacugcugcagcucaauggggacuuccugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacugugaucugcccuagcgcucucuuccagaagaugcccuccaauccuuuccacccuauucccuaacucucgggaccucguuugggaguguucugugggcuuggccuugugucagagcugggaguagcauggacucuggguuucauauccagcugagugagaggguuugagucaaaagccugggugagaauccugccucuccccaaacauuaaucaccaaaguauuaauguacagaguggccccucaccugggccuuuccugugccaaccugaugccccuuccccaagaaggugagugcuugucauggaaaauguccuguggugacaggcccaguggaacagucacccuucugggcaagggggaacaaaucacaccucugggcuucaggguaucccagaccccucucaacacccgccccccccauguuuaaacuuugugccuuugaccaucucuuaggucuaaugauauuuuaugcaaacaguucuuggaccccugaauucaaugacagggaugccaacaccuucuuggcuucugggaccuguguucuugcugagcacccucuccgguuuggguugggauaacagaggcaggaguggcagcuguccccucucccuggggauaugcaacccuuagagauugccccagagccccacucccggccaggcgggagauggaccccucccuugcucagugccuccuggccggggccccucaccccaaggggucuguauauacauuucauaaggccugcccucccauguugcaugccuauguacucuacgccaaagugcagcccuuccuccugaagccucugcccugccucccuuucugggagggcggggugggggugacugaauuugggccucuuguacaguuaacucucccagguggauuuuguggaggugagaaaaggggcauugagacuauaaagcaguagacaauccccacauaccaucuguagaguuggaacugcauucuuuuaaaguuuuauaugcauauauuuuagggcuguagacuuacuuuccuauuuucuuuuccauugcuuauucuugagcacaaaaugauaaucaauuauuacauuuauacaucaccuuuuugacuuuuccaagcccuuuuacagcucuuggcauuuuccucgccuaggccugugagguaacugggaucgcaccuuuuauaccagagaccugaggcagaugaaauuuauuuccaucuaggacuagaaaaacuugggucucuuaccgcgagacugagaggcagaagucagcccgaaugccugucaguuucauggaggggaaacgcaaaaccugcaguuccugaguaccuucuacaggcccggcccagccuaggcccgggguggccacaccacagcaagccggcccccccucuuuuggccuuguggauaagggagaguugaccguuuucauccuggccuccuuuugcuguuuggauguuuccacgggucucacuuauaccaaagggaaaacucuucauuaaaguccguauuucuucuaaaaaaaaaaaaaaaaaaaaaaaaaaa

SEQ ID NO: 145 - RNA, 1208 nt, Homo_Sapiens
ggcggcgacagggagggaggaagccuaggaguccgccgcgggacggaggccugggggaacugggaguucagcuuucugcagagggccacuaggaaccucggauugcccacggaagccagccacuuucuuugacaguccagcccaccuccucuucugcccggagaagcuccaggggcugccuuugugaucacagcaucuucacaaggaccaaaggaaaauaagauuucuuguaagaacaccgugaccacaucuuuaaaaugacccauuucguggcucccacaagauuuacaccuccacacugaggccggaagugguuuugccccuauaaaacauggcgaaaagcuuucuugucuccaaggaaacgccacguaaugagucaaagcuguggcgcacgcgcagaaguacaagcuaccggaagugauggcgccccuacuaaagccuugggguuaguacgcgugcgcagcaguuucuuccgacaguuguguugugccaaugguggagaagaaaacuucgguucgcucccaggaccccgggcagcggcgggugcuggaccgggcugcccggcagcgucgcaucaaccggcagcuggaggcccuggagaaugacaacuuccaggaugacccccacgcgggacucccucagcucggcaagagacugccucaguuugaugacgaugcggacacuggaaagaaaaagaagaaaacccgaggugaucauuuuaaacuucgcuuccgaaaaaacuuucaggcccuguuggaggagcagaacuugaguguggccgagggcccuaacuaccugacggccugugcgggacccccaucgcggccccagcgccccuucugugcugucuguggcuucccaucccccuacaccugugucagcugcggugcccgguacugcacugugcgcugucuggggacccaccaggagaccaggugucugaaguggacugugugagccugggcauucccagagaggaagggccgcugugcacugcccggccuucagaaagacagaauuucaucacccaaugcagggggagcucuuccuggaccaagggaggagccgcucauucacccaacaaaacugugucuuaucugccaggaaagaccagccucacuccugggaacugucuggcagguaggcugggccccccagugcuguuagaauaaaaagccucgugccggaaaaaaaaaaaaaaaaaaaaa

SEQ ID NO: 146 - RNA, 1017 nt, Homo_Sapiens
gaguauuugaggcucggagccaccgccccgccggcgcccgcagcaccuccucgccagcagccguccggagccagccaacgagcggaaaauggcagacaauuuuucgcuccaugaugcguuaucugggucuggaaacccaaacccucaaggauggccuggcgcaugggggaaccagccugcuggggcagggggcuacccaggggcuuccuauccuggggccuaccccgggcaggcacccccaggggcuuauccuggacaggcaccuccaggcgccuacccuggagcaccuggagcuuaucccggagcaccugcaccuggagucuacccagggccacccagcggcccuggggccuacccaucuucuggacagccaagugccaccggagccuacccugccacuggccccuauggcgccccugcugggccacugauugugccuuauaaccugccuuugccugggggaguggugccucgcaugcugauaacaauucugggcacggugaagcccaaugcaaacagaauugcuuuagauuuccaaagagggaaugauguugccuuccacuuuaacccacgcuucaaugagaacaacaggagagucauuguuugcaauacaaagcuggauaauaacuggggaagggaagaaagacagucgguuuucccauuugaaagugggaaaccauucaaaauacaaguacugguugaaccugaccacuucaagguugcagugaaugaugcucacuuguugcaguacaaucaucggguuaaaaaacucaaugaaaucagcaaacugggaauuucuggugacauagaccucaccagugcuucauauaccaugauauaaucugaaaggggcagauuaaaaaaaaaaaaagaaucuaaaccuuacauguguaaagguuucauguucacugugagugaaaauuuuuacauucaucaauaucccucuuguaagucaucuacuuaauaaauauuacagugaauuaccugucucaauaugucaaaaaaaaaaaaaaaaaa

SEQ ID NO: 147 - RNA, 744 nt, Homo_Sapiens
gaguauuugaggcucggagccaccgccccgccggcgcccgcagcaccuccucgccagcagccguccggagccagccaacgagcggaaaauggcagacaauuuuucgcuccaugaugcguuaucugggucuggaaacccaaacccucaaggauggccuggcgcaugggggaaccagccugcuggggcagggggcuacccaggggcuuccuauccuggggccuaccccgggcaggcacccccaggggcuuauccuggacaggcaccuccaggcgccuacccuggagcaccuggagcuuaucccggagcaccugcaccuggagucuacccagggccacccagcggcccuggggccuacccaucuucuggacagccaagugccaccggagccuacccugccacuggccccuauggcgccccugcugggccacugauugugccuuauaaccugccuuugccugggggaguggugccucgcaugcugauaacaauucugggcacggugaagcccaaugcaaacagaauugcuuuagauuuccaaagagggaaugauguugccuuccacuuuaacccacgcuucaaugagaacaacaggagagucauuguuugcacuuacauguguaaagguuucauguucacugugagugaaaauuuuuacauucaucaauaucccucuuguaagucaucuacuuaauaaauauuacagugaauuaccugucucaauaugucaaaaaaaaaaaaaaaaaa

SEQ ID NO: 148 - RNA, 3503 nt, Homo_Sapiens
gcuggugucagagcccggcgagcgcuggcaguuccgcggcggggaugcugaggagcgcuggguccgggagcagcccuggccccugcggacuuccgaggccgugaaaaccccugcgcugcggcccuucccaggcccccgaggccguucgccguucccgaagcccgacugggggaagaguccagcaccaaagcggccguucucggauuccggagcguucuggagccccgagagacgccccgggguucuagaagcuccccggcggcgcccagucccggcuucauucgggcgucccuccgaaacccacucgggugcacgggucgucggcgagccgcgaccggguccuggcgcgcaccaugaucguggcggacuccgagugccgcgcagagcucaaggacuaccugcgguucgccccgggcggcgucggcgacucgggccccggagaggagcagagggagagccgggcucggcgaggcccucgagggcccagcgccuucauccccguggaggagguccuucgggagggggcugagagccucgagcagcaccuggggcuggaggcacugauguccucugggcgaguagacaaccuggcaguggugaugggccugcacccugacuacuuuaccagcuucuggcgccugcacuaccugcugcugcacacggauggucccuuggccagcuccuggcgccacuacauugccaucauggcugccgcccgccaucaguguucuuaccugguaggcucccacauggccgaguuucugcagacugguggugacccugaguggcugcugggccuccaccgggcccccgagaagcugcgcaaacucagcgagaucaacaaguugcuggcgcaucggccauggcucaucaccaaggaacacauccaggccuugcugaagaccggcgagcacacuuggucccuggccgagcucauucaggcucugguccugcucacccacugccacucgcucuccuccuucguguuuggcuguggcauccucccugagggggaugcagauggcagcccugccccccaggcaccuacacccccuagugaacagagcagccccccaagcagggacccguugaacaacucugggggcuuugagucugcccgcgacguggaggcgcugauggagcgcaugcagcagcugcaggagagccugcugcgggaugaggggacgucccaggaggagauggagagccgcuuugagcuggagaagucagagagccugcuggugacccccucagcugacauccuggagcccucuccacacccagacaugcugugcuuuguggaagacccuacuuucggauaugaggacuucacucggagaggggcucaggcacccccuaccuuccgggcccaggauuauaccugggaagaccauggcuacucgcugauccagcggcuuuacccugagggugggcagcugcuggaugagaaguuccaggcagccuauagccucaccuacaauaccaucgccaugcacagugguguggacaccuccgugcuccgcagggccaucuggaacuauauccacugcgucuuuggcaucagauaugaugacuaugauuauggggaggugaaccagcuccuggagcggaaccucaaggucuauaucaagacaguggccugcuacccagagaagaccacccgaagaauguacaaccucuucuggaggcacuuccgccacucagagaagguccacgugaacuugcugcuccuggaggcgcgcaugcaagccgcucugcuguacgcccuccgugccaucacccgcuacaugaccugacuccugagcaggaccugggcccgguucagcuccccacaaggacuucucugucuggagacagccccagacccuuuugugucccaugcccacccuccccacgcugcagugggcuugugugugaugugcagucccgaagccacacccucccuuuuccucacuggaauggacaguucauugcacugacucugggaucucagcccugcuccugggagcuggaagagcacuuggagauccuaagggaccacacccuuccuccuuccccugcccacagaggcagagggcacaggaaagaagccgggccaagcucggaauuaaugugccacaaguguuguggccuuccugaacugggaagucccuggcuggcccccgggggagaggggcaaaugccuccgggacugacacuccaggcagcuuugccuucucuccccugucauuuccagauuucauuaccuccuacuugccauucacccaucaaugugaaagucagggucacagcuggucuguguguccaguucccuaaaagccuguucuguugggcagccugaggcuguugcccgaauccuaguucaguuuuuugacuuccuuugcccuuuuucccuuuucuccaugcuuaauggugugaggcgucaggagagaggccaaguacauaaaaaaaaaaaaagcagauuaucucuagagaguuugagccuuugcuggucacauugccuucugaagaggagggaguauuagauuauaaauccucuuuauuuugguccuuuaugcuugagguuccaaccuggagccacagugugugagaggaggaggagagggagaauucuguucucccagagcugcaccugccucgcagaggccagcaccccacucuccugccuccaguggcccugccgcagaugucucccaaaaaguugagccuuucuagauggcuuagguggcaccauggcucagcaggaggggcgggaggcaccaggguucuuguuuggacccugccccugggccauggccaggugaccauggcuacauugccaaaccucugacugccacagcugcagacugagagggugggucugaguccccacaaugucugaagcugccccugggauucucaggccaaccugccaacagcaagcggauuuucuugcaagaucagggaccccauuucugcagccagugucuccugggugccuucugaggacucccacccccaucccaguaucucaucuguccccucuccuggggcuuaaguggguugcuuccaggcagaagcagccaaggaccgauuccaggcacuuucuguagcaaaugacugugaauuacgacuucucuugcccuucuucuagcagucugugccuccucucugaccaguuuggagggcacugaagaaaggcaagggccgugcugcugcugggcggggcaggagaggagccuggccagugugccacauuaaauacccgugcaggcgcggagaagcaaccggcacccccuuccggccugaaagcccucccugcaagaaggugugcaggagagaagaggccccggcauggggaucuggguucuagagggcaugugaugacuguaaauguucacuggguggguagggagugguauccaguguucaagugcagaaaucuuuggcuuugcuaccaguuccauaugaugagaaauaaacguucgcugagguuuuguuucauaaaaaaaaaaaaaaaaaaa

SEQ ID NO: 149 - RNA, 3963 nt, Homo_Sapiens
ggagagccgaaagcggagcucgaaacugacuggaaacuucaguggcgcggagacucgccaguuucaaccccggaaacuuuucuuugcaggaggagaagagaaggggugcaagcgcccccacuuuugcucuuuuuccuccccuccuccuccucuccaauucgccuccccccacuuggagcgggcagcugugaacuggccaccccgcgccuuccuaagugcucgccgcgguagccggccgacgcgccagcuuccccgggagccgcuugcuccgcauccgggcagccgaggggagaggagcccgcgccucgaguccccgagccgccgcggcuucucgccuuucccggccaccagcccccugccccgggcccgcguaugaaucuccuggaccccuucaugaagaugaccgacgagcaggagaagggccuguccggcgcccccagccccaccauguccgaggacuccgcgggcucgcccugcccgucgggcuccggcucggacaccgagaacacgcggccccaggagaacacguuccccaagggcgagcccgaucugaagaaggagagcgaggaggacaaguuccccgugugcauccgcgaggcggucagccaggugcucaaaggcuacgacuggacgcuggugcccaugccggugcgcgucaacggcuccagcaagaacaagccgcacgucaagcggcccaugaacgccuucauggugugggcgcaggcggcgcgcaggaagcucgcggaccaguacccgcacuugcacaacgccgagcucagcaagacgcugggcaagcucuggagacuucugaacgagagcgagaagcggcccuucguggaggaggcggagcggcugcgcgugcagcacaagaaggaccacccggauuacaaguaccagccgcggcggaggaagucggugaagaacgggcaggcggaggcagaggaggccacggagcagacgcacaucucccccaacgccaucuucaaggcgcugcaggccgacucgccacacuccuccuccggcaugagcgaggugcacucccccggcgagcacucggggcaaucccagggcccaccgaccccacccaccacccccaaaaccgacgugcagccgggcaaggcugaccugaagcgagaggggcgccccuugccagaggggggcagacagcccccuaucgacuuccgcgacguggacaucggcgagcugagcagcgacgucaucuccaacaucgagaccuucgaugucaacgaguuugaccaguaccugccgcccaacggccacccgggggugccggccacgcacggccaggucaccuacacgggcagcuacggcaucagcagcaccgcggccaccccggcgagcgcgggccacguguggauguccaagcagcaggcgccgccgccacccccgcagcagcccccacaggccccgccggccccgcaggcgcccccgcagccgcaggcggcgcccccacagcagccggcggcacccccgcagcagccacaggcgcacacgcugaccacgcugagcagcgagccgggccagucccagcgaacgcacaucaagacggagcagcugagccccagccacuacagcgagcagcagcagcacucgccccaacagaucgccuacagccccuucaaccucccacacuacagccccuccuacccgcccaucacccgcucacaguacgacuacaccgaccaccagaacuccagcuccuacuacagccacgcggcaggccagggcaccggccucuacuccaccuucaccuacaugaaccccgcucagcgccccauguacacccccaucgccgacaccucuggggucccuuccaucccgcagacccacagcccccagcacugggaacaacccgucuacacacagcucacucgaccuugaggaggccucccacgaagggcgaagauggccgagaugauccuaaaaauaaccgaagaaagagaggaccaaccagaauucccuuuggacauuuguguuuuuuuguuuuuuuauuuuguuuuguuuuuucuucuucuucuucuuccuuaaagacauuuaagcuaaaggcaacucguacccaaauuuccaagacacaaacaugaccuauccaagcgcauuacccacuuguggccaaucaguggccaggccaaccuuggcuaaauggagcagcgaaaucaacgagaaacuggacuuuuuaaacccucuucagagcaagcguggaggaugauggagaaucgugugaucagugugcuaaaucucucugccuguuuggacuuuguaauuauuuuuuuagcaguaauuaaagaaaaaaguccucugugaggaauauucucuauuuuaaauauuuuuaguauguacuguguaugauucauuaccauuuugaggggauuuauacauauuuuuagauaaaauuaaaugcucuuauuuuuccaacagcuaaacuacucuuaguugaacagugugcccuagcuuuucuugcaaccagaguauuuuuguacagauuugcuuucucuuacaaaaagaaaaaaaaaauccuguuguauuaacauuuaaaaacagaauuguguuaugugaucaguuuuggggguuaacuuugcuuaauuccucaggcuuugcgauuuaaggaggagcugccuuaaaaaaaaauaaaggccuuauuuugcaauuaugggaguaaacaauagucuagagaagcauuugguaagcuuuaucauauauauauuuuuuaaagaagagaaaaacaccuugagccuuaaaacggugcugcugggaaacauuugcacucuuuuagugcauuuccuccugccuuugcuuguucacugcagucuuaagaaagagguaaaaggcaagcaaaggagaugaaaucuguucugggaauguuucagcagccaauaagugcccgagcacacugcccccgguugccugccugggccccauguggaaggcagaugccugcucgcucugucaccugugccucucagaacaccagcaguuaaccuucaagacauuccacuugcuaaaauuauuuauuuuguaaggagagguuuuaauuaaaacaaaaaaaaauucuuuuuuuuuuuuuuuuccaauuuuaccuucuuuaaaauagguuguuggagcuuuccucaaaggguauggucaucuguuguuaaauuauguucuuaacuguaaccaguuuuuuuuuauuuaucucuuuaaucuuuuuuuauuauuaaaagcaaguuucuuuguauuccucacccuagauuuguauaaaugccuuuuuguccaucccuuuuuucuuuguuguuuuuguugaaaacaaacuggaaacuuguuucuuuuuuuguauaaaugagagauugcaaauguaguguaucacugagucauuugcaguguuuucugccacagaccuuugggcugccuuauauuguguguguguguggguguguguguguuuugacacaaaaacaaugcaagcaugugucauccauauuucucugcaucuucucuuggagugagggaggcuaccuggaggggaucagcccacugacagaccuuaaucuuaauuacugcuguggcuagagaguuugaggauugcuuuuuaaaaaagacagcaaacuuuuuuuuuuauuuaaaaaaagauauauuaacaguuuuagaagucaguagaauaaaaucuuaaagcacucauaauauggcauccuucaauuucuguauaaaagcagaucuuuuuaaaaagauacuucuguaacuuaagaaaccuggcauuuaaaucauauuuugucuuuagguaaaagcuuugguuuguguucguguuuuguuuguuucacuuguuucccucccagccccaaaccuuuuguucucuccgugaaacuuaccuuucccuuuuucuuucucuuuuuuuuuuuuguauauuauuguuuacaauaaauauacauugcauuaaaaagaaaaaaaaaaaaaaaaaaaaaaaaaaaaaaa

SEQ ID NO: 150 - RNA, 4976 nt, Homo_Sapiens
gggcgggcgggccgcaggcugucgggcuggggcugaggcugaggcugagguugaggcggcggcggcggcggccgggugcccgggacagcgacgcagcgcgccggcggccgcgacagggccagcgagagccccgcagcccgccgcagcugccgccucgccgcggccgggccggagagcacggcggcgggagcgcggccuuaggaggcggccggagcggugggcacagcucggcgcggagcguccugucaggcggcggccgagggcgucgcggacucuccccgcgaugaugccgaugauauuaacuguuuucuugagcaacaaugaacagauuuuaacagaaguuccuauaacaccggaaacaaccugucgagauguuguagaauuuugcaaggaaccuggagaaggcagcugccauuuagcugaaguguggaggggaaaugaacgucccauacccuuugaucauaugauguacgaacaucuucagaaaugggguccacggagggaagaagugaaauuuuuccuucgacacgaggacuccccaacugagaacagugaacaagguggccgucagacccaagagcaacgaacucagagaaauguaauaaauguaccuggagaaaaacguacugaaaaugggguugggaauccacguguugaacuuacccucucagagcuccaagauauggcagcuaggcaacagcagcagauugaaaaucagcagcagauguugguugccaaggaacagcguuuacauuuucuaaagcaacaggagcgccgucagcagcagucuauuucugaaaaugaaaagcuucagaaauugaaagaacgaguugaagcccaggagaacaagcugaagaaaauucgugcaaugagaggacaagucgacuacagcaaaaucaugaacggcaaucugucugcugaaauagaaagguucagugccauguuccaggaaaagaagcaggaaguacagacugcaauuuuaaggguugaucagcuuagucagcaauuggaagauuuaaagaaaggaaaacugaauggguuccagucuuacaauggcaaauugacgggaccagcggcgguggaguuaaaaagacuguaccaagaacuacagauucguaaccaacuuaaccaggaacaaaauucaaaacuucagcagcagaaggaacucuuaaauaagcgcaacauggagguggccaugauggacaagcgaaucagugaacugcgugaacgucucuaugggaaaaaaauucagcugaaccgugugaauggcacgucaucaccacaguccccucugagcacaucgggcagggucgcugcuguggggccuuauauccagguucccagugccggaagcuuuccugugcugggggacccuauaaagccccagucucucaguauugccucaaaugcugcucauggaagauccaaauccgcuaaugauggaaacuggccaacauuaaaacagaauucuagcucuuccgugaaaccagugcagguggccggugcagacuggaaggauccgagcguggaggggucugucaagcagggcacugucuccagccagccugugcccuucucagcacugggacccacggagaagccgggcaucgagauugguaaagugccaccucccaucccggguguaggcaagcagcugccuccaagcuaugggacauacccaaguccuacaccucuggguccugggucgacaagcucccuggaaaggaggaaggaaggcagcuugcccaggcccagugcaggccugccaagucgacagaggcccacccugcugcccgccacaggcagcaccccccagccaggcuccucacaacagauucagcagaggauuuccguaccgccaagucccacguacccgccagcgggaccaccugcauuuccagcuggggacagcaagccugaacucccacugacaguggccauuaggccuuuccuggcugauaaagggucaaggccacagucucccaggaaaggaccccagacagugaauucaaguuccauauacuccauguaccuccagcaagccacaccaccuaagaauuaccagccggcagcacacagcgccuuaaauaagucaguuaaagcaguguaugguaagcccguuuuaccuucggguucaaccucuccaucgccgcugccguuucuucacgggucacuguccacgggcacaccacagccucagccaccuucagaaaguacugagaaagagccugagcaggauggccccgccgcccccgcagauggcagcaccguggagagccugccacggccacucagccccaccaagcucacgcccaucgugcauucgccacugcgcuaccagagugaugcagaccuggaggcccuccgcaggaagcuggccaacgcgccccggccccugaaaaagcgcagcuccaucacagagcccgagggccccggcgggcccaacauccagaagcugcuguaccagcgcuucaacacccuggccgguggcauggagggcaccccuuucuaccagcccagccccucccaggacuucaugggcaccuuggccgauguggacaauggaaacaccaaugccaauggaaaccuggaagagcuccccccugcccagcccacagccccacuccccgcugagccugccccgucaucagaugccaaugauaaugaguuaccuucccccgaaccagaggagcucaucuguccccaaaccacccaccaaacugccgagccggcagaggacaauaacaacaacguggccacgguccccaccacggagcagaucccgaguccuguggcugaggccccaucuccaggggaagagcaggucccuccagcaccucuucccccugccagccacccuccugccaccuccacgaacaagcggaccaacuugaagaagcccaacucggagcggacggggcacgggcugagaguccgguuuaacccccuggcacugcuccuagacgcgucucuggaaggagaguucgaucuggugcagaggaucaucuaugagguggaagaucccagcaagcccaacgacgaagggaucaccccacugcacaacgccgucugcgccggccaccaucacaucgugaaguuccugcuggauuuuggugucaacgugaaugcugcugauagugauggauggacgccgcugcacugcgcugccucuuguaacagcguucaccucugcaaacagcugguggagaguggugccgccauuuuugccucaaccauaagcgacauugaaacugcugcagacaagugugaggagauggaggaaggcuacauccagugcucccaguuucuauauggggugcaggaaaagcugggugugaugaacaaagguguggcguaugcucugugggacuacgaggcccagaacagugacgagcuguccuuccacgaaggggacgcccucaccauccugaggcgcaaggacgaaagcgagacugagugguggugggcucgccuuggagaccgggagggcuaugugcccaaaaaccugcuggggcuguauccacggaucaaaccccgacagcgaacacucgccugaacuuccuuuuggagcaccgcauggucuugccagcuaccaggagccacuuaagagauuauugugcuguuuuccaggaaagcugcagcuagaaaauggucuuaauggugcucacuuuagcagacagcguccacaaugugaauccuacaguuuccaggugaggcccuuucuccaguuugcccauuaacugggagagguacuuucgccuccaaggacugaauuuugccaauuacuauaaauccaaauaaauacccacuuucaaaacacccaccccucuugccauuaagaagucccauaacccccgguugguugccagugaagacagaagcucuuacugacuuggccccgaggccaucacccccuccagcagugaacacuguccgccgcugugaggccugcuccccugcgaccgcccugccccccgucaccgaaucggacacucauccuuucucacacuucccacacaugauccuucuucccuucaucaccaaaggagccucuguauggaaacauguccaguguugcugcccaguguguaugccucccaguacccacucugcucggccgccuuggggguuccgcuuccuguuccaguucaccuaaaggcugauugugcaggcccagcacuguggcuggacugccgcgccacgggcaccaggaccccuaagaccaagugacaacugggagagccucagcauauacucuucuccuccgaucucacagccugucaugcugcucagugugguucucaccccugcaagcucaaauucaguucccugaauggagucaggugcuggaggccguggcagcggagggugguugggguuggggcuggggguggacuggugugagggcagaccagggccagguagacggggcuguuuggugccugaaggauggcagacgccuggugucaggaggggccgccaccaaggagcagcagcuggggcagaggagcuggggucaggggccaccccucucugccgaucucccugccugggcuggcugugaggccaccuuugucccaggcccagccucaaggcaaggagggcgcuucacugaggugugaauuguacguacaggcuuuuuauauaccaaaaguauuuuuugacuagaccauucaaagcuacccgaacuauguuggaaauuuuuuuuuucucauuaaaauacaggcccuuaggcucuauuuuucauguaugagucguguguaauuuauguaaaaauguguguacagacucacugaugcagcacuguagcccaucaccuuggagcacugacuguacauaguguggugaagaaaagugaacgcccuuguagagcagcccgaccacaggagcauggccgcugccagcccagacgcugcugacgcuguguaaaugugcacaauaaacccgucucaccccggcaaaaaaaaaaaaaaaaa

SEQ ID NO: 151 - RNA, 2205 nt, Homo_Sapiens
gcgcacgccggccgcgcccacgugaccgguccgggugcaaacacgcgggucagcugauccggcccaacugcggcgucaucccggcuauaagcgcacggccucggcgacccucuccgacccggccgccgccgccaugcagcccuccagccuucugccgcucgcccucugccugcuggcugcacccgccuccgcgcucgucaggaucccgcugcacaaguucacguccauccgccggaccaugucggagguugggggcucuguggaggaccugauugccaaaggccccgucucaaaguacucccaggcggugccagccgugaccgaggggcccauucccgaggugcucaagaacuacauggacgcccaguacuacggggagauuggcaucgggacgcccccccagugcuucacagucgucuucgacacgggcuccuccaaccuguggguccccuccauccacugcaaacugcuggacaucgcuugcuggauccaccacaaguacaacagcgacaaguccagcaccuacgugaagaaugguaccucguuugacauccacuauggcucgggcagccucuccggguaccugagccaggacacugugucggugcccugccagucagcgucgucagccucugcccugggcggugucaaaguggagaggcaggucuuuggggaggccaccaagcagccaggcaucaccuucaucgcagccaaguucgauggcauccugggcauggccuacccccgcaucuccgucaacaacgugcugcccgucuucgacaaccugaugcagcagaagcugguggaccagaacaucuucuccuucuaccugagcagggacccagaugcgcagccugggggugagcugaugcuggguggcacagacuccaaguauuacaaggguucucuguccuaccugaaugucacccgcaaggccuacuggcagguccaccuggaccagguggagguggccagcgggcugacccugugcaaggagggcugugaggccauuguggacacaggcacuucccucauggugggcccgguggaugaggugcgcgagcugcagaaggccaucggggccgugccgcugauucagggcgaguacaugauccccugugagaagguguccacccugcccgcgaucacacugaagcugggaggcaaaggcuacaagcuguccccagaggacuacacgcucaaggugucgcaggccgggaagacccucugccugagcggcuucaugggcauggacaucccgccacccagcgggccacucuggauccugggcgacgucuucaucggccgcuacuacacuguguuugaccgugacaacaacagggugggcuucgccgaggcugcccgccucuaguucccaaggcguccgcgcgccagcacagaaacagaggagagucccagagcaggaggccccuggcccagcggccccucccacacacacccacacacucgcccgcccacuguccugggcgcccuggaagccggcggcccaagcccgacuugcuguuuuguucugugguuuuccccucccuggguucagaaaugcugccugccugucugucucuccaucuguuugguggggguagagcugauccagagcacagaucuguuucgugcauuggaagaccccacccaagcuuggcagccgagcucguguauccuggggcucccuucaucuccagggaguccccuccccggcccuaccagcgcccgcugggcugagccccuaccccacaccaggccguccucccgggcccucccuuggaaaccugcccugccugagggccccucugcccagcuugggcccagcugggcucugccacccuaccuguucagugucccgggcccguugaggaugaggccgcuagaggccugaggaugagcuggaaggagugagaggggacaaaacccaccuuguuggagccugcaggguggugcugggacugagccagucccaggggcauguauuggccuggaggugggguugggauugggggcuggugccagccuuccucugcagcugaccucuguuguccuccccuugggcggcugagagccccagcugacauggaaauacaguuguuggccuccggccuccccucaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 152 - RNA, 1492 nt, Homo_Sapiens
cgggcgacagcagggccgcggugcaguguccgacccgagaguugcggccugagucaccggccccgcccuccggagccggacgcugcgggaggcccgggagcggcaguggaaccgacucccagaacuccggacgugugcggcgcagugagucgcagccauguuccugguuaacucguucuugaagggcggcggcggcggcggcgggggaggcgggggccugggugggggccugggaaaugugcuuggaggccugaucagcggggccgggggcggcggcggcggcggcggcggcggcggcggugguggaggcggcgguggcgguggaacggccaugcgcauccuaggcggagucaucagcgccaucagcgaggcggcugcgcaguacaacccggagcccccgcccccacgcacacauuacuccaacauugaggccaacgagagugaggagguccggcaguuccggagacucuuugcccagcuggcuggagaugacauggaggucagcgccacagaacucaugaacauucucaauaagguugugacacgacacccugaucugaagacugaugguuuuggcauugacacaugucgcagcaugguggccgugauggauagcgacaccacaggcaagcugggcuuugaggaauucaaguacuuguggaacaacaucaaaagguggcaggccauauacaaacaguucgacacugaccgaucagggaccauuugcaguagugaacucccaggugccuuugaggcagcaggguuccaccugaaugagcaucucuauaacaugaucauccgacgcuacucagaugaaagugggaacauggauuuugacaacuucaucagcugcuuggucaggcuggacgccauguuccgugccuucaaaucucuugacaaagauggcacuggacaaauccaggugaacauccaggaguggcugcagcugacuauguauuccugaacuggagccccagacccgcccccucacugccuugcuauaggagucaccuggagccucggucucucccagggccgauccugucugcagucacaucuuuguggggccugcugacccacaagcuuuuguucucucaguacuuguuacccagcuucucaacauccagggcccaauuugcccugccuggaguucccccuggcucuaggacacucuaacaagcucuguccacgggucuccccauucccaccaggcccugcacacacccacuccguaaccucuccccuguaccugugccaagccuagcacuugugaugccuccaugccccgagggcccucucucaguucugggaggaugacuccagucccugcacgcccuggcacacccuucacgguugcuacccaggcggccaagcuccagaccgugccagacccaggugccccagugccuuugucuauauucugcucccagccugccaggcccaggaggaaauaaacaugccccaguugcugaucucuaaaaaaaaaaaaaaa

SEQ ID NO: 153 - RNA, 1489 nt, Homo_Sapiens
cgggcgacagcagggccgcggugcaguguccgacccgagaguugcggccugagucaccggccccgcccuccggagccggacgcugcgggaggcccgggagcggcaguggaaccgacucccagaacuccggacgugugcggcgugagucgcagccauguuccugguuaacucguucuugaagggcggcggcggcggcggcgggggaggcgggggccugggugggggccugggaaaugugcuuggaggccugaucagcggggccgggggcggcggcggcggcggcggcggcggcggcggugguggaggcggcgguggcgguggaacggccaugcgcauccuaggcggagucaucagcgccaucagcgaggcggcugcgcaguacaacccggagcccccgcccccacgcacacauuacuccaacauugaggccaacgagagugaggagguccggcaguuccggagacucuuugcccagcuggcuggagaugacauggaggucagcgccacagaacucaugaacauucucaauaagguugugacacgacacccugaucugaagacugaugguuuuggcauugacacaugucgcagcaugguggccgugauggauagcgacaccacaggcaagcugggcuuugaggaauucaaguacuuguggaacaacaucaaaagguggcaggccauauacaaacaguucgacacugaccgaucagggaccauuugcaguagugaacucccaggugccuuugaggcagcaggguuccaccugaaugagcaucucuauaacaugaucauccgacgcuacucagaugaaagugggaacauggauuuugacaacuucaucagcugcuuggucaggcuggacgccauguuccgugccuucaaaucucuugacaaagauggcacuggacaaauccaggugaacauccaggaguggcugcagcugacuauguauuccugaacuggagccccagacccgcccccucacugccuugcuauaggagucaccuggagccucggucucucccagggccgauccugucugcagucacaucuuuguggggccugcugacccacaagcuuuuguucucucaguacuuguuacccagcuucucaacauccagggcccaauuugcccugccuggaguucccccuggcucuaggacacucuaacaagcucuguccacgggucuccccauucccaccaggcccugcacacacccacuccguaaccucuccccuguaccugugccaagccuagcacuugugaugccuccaugccccgagggcccucucucaguucugggaggaugacuccagucccugcacgcccuggcacacccuucacgguugcuacccaggcggccaagcuccagaccgugccagacccaggugccccagugccuuugucuauauucugcucccagccugccaggcccaggaggaaauaaacaugccccaguugcugaucucuaaaaaaaaaaaaaaa

SEQ ID NO: 154 - RNA, 2755 nt, Homo_Sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacauggcuuagaaguggaaauaaacugcacccggacccagaauaccaagugcagauguaaaccaaacuuuuuuuguaacucuacuguaugugaacacugugacccuugcaccaaaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 155 - RNA, 2692 nt, Homo_Sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacauggcuuagaaguggaaauaaacugcacccggacccagaauaccaagugcagauguaaaccaaacuuuuuuuguaacucuacuguaugugaacacugugacccuugcaccaaaugugaacauggaaucaucaaggaaugcacacucaccagcaacaccaagugcaaagaggaagugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 156 - RNA, 2730 nt, Homo_Sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacauggcuuagaaguggaaauaaacugcacccggacccagaauaccaagugcagauguaaaccaaacuuuuuuuguaacucuacuguaugugaacacugugacccuugcaccaaaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccuauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 157 - RNA, 2646 nt, Homo_Sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacaugaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 158 - RNA, 2583 nt, Homo_Sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacaugaugugaacauggaaucaucaaggaaugcacacucaccagcaacaccaagugcaaagaggaagugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 159 - RNA, 2445 nt, Homo_Sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccagaugugaacauggaaucaucaaggaaugcacacucaccagcaacaccaagugcaaagaggaagugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 160 - RNA, 2508 nt, Homo_Sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccagaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 161 - RNA, 1909 nt, Homo_Sapiens
gagguguuucccuuagcuauggaaacucuauaagagagauccagcuugccuccucuugagcagucagcaacagggucccguccuugacaccucagccucuacaggacugagaagaaguaaaaccguuugcuggggcuggccugacucaccagcugccaugcagcagcccuucaauuacccauauccccagaucuacuggguggacagcagugccagcucucccugggccccuccaggcacaguucuucccuguccaaccucugugcccagaaggccuggucaaaggaggccaccaccaccaccgccaccgccaccacuaccaccuccgccgccgccgccaccacugccuccacuaccgcugccaccccugaagaagagagggaaccacagcacaggccugugucuccuugugauguuuuucaugguucugguugccuugguaggauugggccuggggauguuucagcucuuccaccuacagaaggagcuggcagaacuccgagagucuaccagccagaugcacacagcaucaucuuuggagaagcaaauaggccaccccaguccacccccugaaaaaaaggagcugaggaaaguggcccauuuaacaggcaaguccaacucaagguccaugccucuggaaugggaagacaccuauggaauuguccugcuuucuggagugaaguauaagaaggguggccuugugaucaaugaaacugggcuguacuuuguauauuccaaaguauacuuccggggucaaucuugcaacaaccugccccugagccacaaggucuacaugaggaacucuaaguauccccaggaucuggugaugauggaggggaagaugaugagcuacugcacuacugggcagaugugggcccgcagcagcuaccugggggcaguguucaaucuuaccagugcugaucauuuauaugucaacguaucugagcucucucuggucaauuuugaggaaucucagacguuuuucggcuuauauaagcucuaagagaagcacuuugggauucuuuccauuaugauucuuuguuacaggcaccgagaauguuguauucagugagggucuucuuacaugcauuugaggucaaguaagaagacaugaaccaaguggaccuugagaccacaggguucaaaaugucuguagcuccucaacucaccuaauguuuaugagccagacaaauggaggaauaugacggaagaacauagaacucugggcugccaugugaagagggagaagcaugaaaaagcagcuaccagguguucuacacucaucuuagugccugagaguauuuaggcagauugaaaaggacaccuuuuaacucaccucucaaggugggccuugcuaccucaagggggacugucuuucagauacaugguugugaccugaggauuuaagggauggaaaaggaagacuagaggcuugcauaauaagcuaaagaggcugaaagaggccaaugccccacuggcagcaucuucacuucuaaaugcauauccugagccaucggugaaacuaacagauaagcaagagagauguuuuggggacucauuucauuccuaacacagcauguguauuuccagugcaauuguagggguguguguguguguguguguguguguguguguaugacuaaagagagaauguagauauugugaaguacauauuaggaaaauauggguugcauuuggucaagauuuugaaugcuuccugacaaucaacucuaauagugcuuaaaaaucauugauugucagcuacuaaugauguuuuccuauaauauaauaaauauuuauguagaugugcauuuuugugaaaugaaaacauguaauaaaaaguauauguuaggauacaaaaaaaaaaaaaaaaaaaaaaaaaaaaaaaaaaaaaaaaaaaaaaaaaaaa

SEQ ID NO: 162 - RNA, 3007 nt, Homo_Sapiens
aaggagagagggagggcggagggcggaggggcggcgggaggagggcggggaggagcgcucuuccugguugggcccugcccugagcugccaccgggaagccagccucagggacugcagcgacccccaaacaccccucccccaggaugucggaggagaucaucacgccgguguacugcacuggggugucagcccaagugcagaagcagcgggccagggagcugggccugggccgccaugagaaugccaucaaguaccugggccaggauuaugagcagcugcgggugcgaugccugcagagugggacccucuuccgugaugaggccuuccccccgguaccccagagccuggguuacaaggaccugggucccaauuccuccaagaccuauggcaucaaguggaagcgucccacggaacugcugucaaacccccaguucauuguggauggagcuacccgcacagacaucugccagggagcacugggggacugcuggcucuuggcggccauugccucccucacucucaacgacacccuccugcaccgagugguuccgcacggccagagcuuccagaauggcuaugccggcaucuuccauuuccagcuguggcaauuuggggaguggguggacguggucguggaugaccugcugcccaucaaggacgggaagcuaguguucgugcacucugccgaaggcaacgaguucuggagcgcccugcuugagaaggccuaugccaagguaaauggcagcuacgaggcccugucagggggcagcaccucagagggcuuugaggacuucacaggcgggguuaccgagugguacgaguugcgcaaggcucccagugaccucuaccagaucauccucaaggcgcuggagcggggcucccugcugggcugcuccauagacaucuccagcguucuagacauggaggccaucacuuucaagaaguuggugaagggccaugccuacucugugaccggggccaagcaggugaacuaccgaggccagguggugagccugauccggaugcggaaccccuggggcgagguggaguggacgggagccuggagcgacagcuccucagaguggaacaacguggacccauaugaacgggaccagcuccgggucaagauggaggacggggaguucuggaugucauuccgagacuucaugcgggaguucacccgccuggagaucugcaaccucacacccgacgcccucaagagccggaccauccgcaaauggaacaccacacucuacgaaggcaccuggcggcgggggagcaccgcggggggcugccgaaacuacccagccaccuucugggugaacccucaguucaagauccggcuggaugagacggaugacccggacgacuacggggaccgcgagucaggcugcagcuucgugcucgcccuuaugcagaagcaccgucgccgcgagcgccgcuucggccgcgacauggagacuauuggcuucgcggucuacgaggucccuccggagcuggugggccagccggccguacacuugaagcgugacuucuuccuggccaaugcgucucgggcgcgcucagagcaguucaucaaccugcgagaggucagcacccgcuuccgccugccacccggggaguaugugguggugcccuccaccuucgagcccaacaaggagggcgacuucgugcugcgcuucuucucagagaagagugcugggacuguggagcuggaugaccagauccaggccaaucuccccgaugagcaagugcucucagaagaggagauugacgagaacuucaaggcccucuucaggcagcuggcaggggaggacauggagaucagcgugaaggaguugcggacaauccucaauaggaucaucagcaaacacaaagaccugcggaccaagggcuucagccuagagucgugccgcagcauggugaaccucauggaucgugauggcaaugggaagcugggccugguggaguucaacauccuguggaaccgcauccggaauuaccuguccaucuuccggaaguuugaccuggacaagucgggcagcaugagugccuacgagaugcggauggccauugagucggcaggcuucaagcucaacaagaagcuguacgagcucaucaucacccgcuacucggagcccgaccuggcggucgacuuugacaauuucguuugcugccuggugcggcuagagaccauguuccgauuuuucaaaacucuggacacagaucuggauggaguugugaccuuugacuuguuuaagugguugcagcugaccauguuugcaugaggcagggacucggucccccuugccgugcuccccucccuccucgucugccaagccucgccuccuaccacaccacaccaggccaccccagcugcaagugccuuccuuggagcagagaggcagccucguccuccuguccccucuccucccagccaccaucguucaucugcuccgggcagaacuguguggccccugccugugccagccaugggcucgggauggacucccugggccccacccauugccaagccaggaaggcagcuuucgcuuguuccugccucgggacagccccggguuuccccagcauccugauguguccccucuccccacuucagaggccacccacucagcaccaccggccuggccuugccugcagacuauaaacuauaaccacuagcucgacacagucugcaguccaggcguguggagccgccucccggcucggggaggccccggggcugggaacgccugugccuuccugcgccgaagccaacgcccccucuguccuucccuggcccugcugccgaccaggagcugcccagccugugggcggucggccuucccuccuucgcuccuuuuuuauauuagugauuuuaaaggggacucuucagggacuuguguacugguuaugggggugccagaggcacuaggcuugggguggggaggucccguguuccauauagaggaaccccaaauaauaaaaggccccacaucugucugug

SEQ ID NO: 163 - RNA, 1855 nt, Homo_Sapiens
gacgauacgccgggcgcaggcgcagaagccgcgcccguccgcggcgccgccagccagggcggaaacggcugcggcuucgcuagggacgcaugcgcgggucccuuaguuuucgcgagauaacggucgaaaacgcgcucuugucgauuuccuguagugaaucaggcaccggagugcagguucggggguggaauccuugggccgcugggcaagcggcgagaccuggccagggccagcgagccgaggacagagggcgcacggagggccgggccgcagccccggccgcuugcagaccccgccauggacccguuccuggugcugcugcacucggugucguccagccugucgagcagcgagcugaccgagcucaaguuccuaugccucgggcgcgugggcaagcgcaagcuggagcgcgugcagagcggccuagaccucuucuccaugcugcuggagcagaacgaccuggagcccgggcacaccgagcuccugcgcgagcugcucgccucccugcggcgccacgaccugcugcggcgcgucgacgacuucgaggcgggggcggcggccggggccgcgccuggggaagaagaccugugugcagcauuuaacgucauaugugauaauguggggaaagauuggagaaggcuggcucgucagcucaaagucucagacaccaagaucgacagcaucgaggacagauacccccgcaaccugacagagcgugugcgggagucacugagaaucuggaagaacacagagaaggagaacgcaacaguggcccaccuggugggggcucucagguccugccagaugaaccugguggcugaccugguacaagagguucagcaggcccgugaccuccagaacaggaguggggccauguccccgaugucauggaacucagacgcaucuaccuccgaagcguccugaugggccgcugcuuugcgcugguggaccacaggcaucuacacagccuggacuuugguucucuccaggaagguagcccagcacugugaagacccagcaggaagccaggcugagugagccacagaccaccugcuucugaacucaagcugcguuuauuaaugccucucccgcaccaggccgggcuugggcccugcacagauauuuccauuucuuccucacuaugacacugagcaagaucuugucuccacuaaaugagcuccugcgggaguaguuggaaaguuggaaccguguccagcacagaaggaaucugugcagaugagcagucacacuguuacuccacagcggaggagaccagcucagaggcccaggaaucggagcgaagcagagagguggagaacugggauuugaacccccgccauccuucaccagagcccaugcucaaccacuguggcguucugcugccccugcaguuggcagaaaggauguuuugucccauuuccuuggaggccaccgggacagaccuggacacuagggucaggcggggugcugugguggggagaggcauggcugggguggggguggggagaccugguuggccgugguccagcucuuggccccugugugaguugagucuccucucugagacugcuaaguaggggcagugaugguugccaggacgaauugagauaauaucugugaggugcugaugagugauugacacacagcacucucuaaaucuuccuugugaggauuauggguccugcaauucuacaguuucuuacuguuuuguaucaaaaucacuaucuuucugauaacagaauugccaaggcagcgggaucucguaucuuuaaaaagcaguccucuuauuccuaagguaauccuauuaaaacacagcuuuacaacuuccauacuacaaaaaauuuucuauuccuaa

SEQ ID NO: 164 - RNA, 3420 nt, Homo_Sapiens
agagcgagccgagccgcggccagcuccggcgggcagggggggcgcuggagcgcagcgcagcgcagccccaucaguccgcaaagcggaccgagcuggaagucgagcgcugccgcgggaggcgggcgaugggggcaggugccaccggccgcgccauggacgggccgcgccugcugcuguugcugcuucugggggugucccuuggaggugccaaggaggcaugccccacaggccuguacacacacagcggugagugcugcaaagccugcaaccugggcgaggguguggcccagccuuguggagccaaccagaccgugugugagcccugccuggacagcgugacguucuccgacguggugagcgcgaccgagccgugcaagccgugcaccgagugcguggggcuccagagcaugucggcgccgugcguggaggccgacgacgccgugugccgcugcgccuacggcuacuaccaggaugagacgacugggcgcugcgaggcgugccgcgugugcgaggcgggcucgggccucguguucuccugccaggacaagcagaacaccgugugcgaggagugccccgacggcacguauuccgacgaggccaaccacguggacccgugccugcccugcaccgugugcgaggacaccgagcgccagcuccgcgagugcacacgcugggccgacgccgagugcgaggagaucccuggccguuggauuacacgguccacacccccagagggcucggacagcacagcccccagcacccaggagccugaggcaccuccagaacaagaccucauagccagcacgguggcagguguggugaccacagugaugggcagcucccagcccguggugacccgaggcaccaccgacaaccucaucccugucuauugcuccauccuggcugcugugguugugggccuuguggccuacauagccuucaagagguggaacagcugcaagcagaacaagcaaggagccaacagccggccagugaaccagacgcccccaccagagggagaaaaacuccacagcgacaguggcaucuccguggacagccagagccugcaugaccagcagccccacacgcagacagccucgggccaggcccucaagggugacggaggccucuacagcagccugcccccagccaagcgggaggagguggagaagcuucucaacggcucugcgggggacaccuggcggcaccuggcgggcgagcugggcuaccagcccgagcacauagacuccuuuacccaugaggccugccccguucgcgcccugcuugcaagcugggccacccaggacagcgccacacuggacgcccuccuggccgcccugcgccgcauccagcgagccgaccucguggagagucugugcagugaguccacugccacauccccggugugagcccaaccggggagcccccgccccgccccacauuccgacaaccgaugcuccagccaaccccuguggagcccgcacccccacccuuuggggggggcccgccuggcagaacugagcuccucugggcaggaccucagaguccaggccccaaaaccacagcccugucagugcagcccguguggccccuucacuucugaccacacuuccuguccagagagagaagugccccugcugccuccccaacccugccccugccccgucaccaucucaggccaccugcccccuucucccacacugcuaggugggccagccccucccaccacagcaggugucauauauggggggccaacaccagggaugguacuagggggaagugacaaggccccagagacucagagggaggaaucgaggaaccagagccauggacucuacacugugaacuuggggaacaaggguggcaucccaguggccucaacccucccucagccccucuugccccccaccccagccuaagaugaagaggaucggaggcuugucagagcugggagggguuuucgaagcucagcccaccccccucauuuuggauauaggucagugaggcccagggagaggccaugauucgcccaaagccagacagcaacggggaggccaagugcaggcuggcaccgccuucucuaaaugaggggccucagguuugccugagggcgaggggaggguggcaggugaccuucugggaaauggcuugaagccaagucagcuuugccuuccacgcugucuccagacccccaccccuuccccacugccugcccacccguggagaugggaugcuugccuagggccugguccaugauggagucagguuugggguucguggaaagggugcugcuucccucugccugucccucucaggcaugccugugugacaucaguggcauggcuccagucugcugcccuccaucccgacauggacccggagcuaacacuggccccuagaaucagccuaggggucagggaccaaggaccccucaccuugcaacacacagacacacgcacacacacacacaggaggagaaaucucacuuuucuccaugaguuuuuucucuugggcugagacuggauacugcccggggcagcugccagagaagcaucggagggaauugaggucugcucggccgucuucacucgcccccggguuuggcgggccaaggacugccgaccgaggcuggagcuggcgucugucuucaagggcuuacacguggaggaaugcucccccauccuccccuucccugcaaacaugggguuggcugggcccagaagguugugaugaagaaaagugggccagugugggaaugcggcaagaaggaauugacuucgacugugaccuguggggauuucucccagcucuagacaacccugcaaaggacuguuuuuuccugagcuuggccagaagggggccaugaggccucaguggacuuuccacccccucccuggccuguucuguuuugccugaaguuggagugaguguggcuccccucuauuuagcaugacaagccccaggcaggcugugcgcugacaaccaccgcuccccagcccaggguucccccagcccuguggaagggacuaggagcacuguaguaaauggcaauucuuugaccucaaccugugaugaggggaggaaacucaccugcuggccccucaccugggcaccuggggagugggacagagucuggguguauuuauuuuccuccccagcagguggggaggggguuugggggcuugcaaguauguuuuagcauguguuugguucuggggccccuuuuuacuccccuugagcugagauggaacccuuuuggcccccgagcugggggccaugagcuccagacccccagcaacccuccuaucaccuccccuccuugccuccuguguaaucauuucuugggcccuccugaaacuuacacacaaaacguuaagugaugaacauuaaauagcaaagaaagaaaaauaguacaaagag

SEQ ID NO: 165 - RNA, 4073 nt, Homo_Sapiens
auuccuagggccgggcgcgggggcggggaggccuggaggauuuaacccaggagagccgcuggugggaggcgcggcuggcgccgcugcgcgcaugggccuguuccuggcccgcagccgccaccuacccagugaccaugauaguguuugucagguucaacuccagccaugguuucccaguggaggucgauucugacaccagcaucuuccagcucaaggaggugguugcuaagcgacaggggguuccggcugaccaguugcgugugauuuucgcagggaaggagcugaggaaugacuggacugugcagaauugugaccuggaucagcagagcauuguucacauugugcagagaccguggagaaaaggucaagaaaugaaugcaacuggaggcgacgaccccagaaacgcggcgggaggcugugagcgggagccccagagcuugacucggguggaccucagcagcucaguccucccaggagacucuguggggcuggcugucauucugcacacugacagcaggaaggacucaccaccagcuggaaguccagcagguagaucaaucuacaacagcuuuuauguguauugcaaaggccccugucaaagagugcagccgggaaaacucaggguacagugcagcaccugcaggcaggcaacgcucaccuugacccaggguccaucuugcugggaugauguuuuaauuccaaaccggaugaguggugaaugccaauccccacacugcccugggacuagugcagaauuuuucuuuaaauguggagcacaccccaccucugacaaggaaacaucaguagcuuugcaccugaucgcaacaaauagucggaacaucacuugcauuacgugcacagacgucaggagccccguccugguuuuccagugcaacucccgccacgugauuugcuuagacuguuuccacuuauacugugugacaagacucaaugaucggcaguuuguucacgacccucaacuuggcuacucccugccuuguguggcuggcugucccaacuccuugauuaaagagcuccaucacuucaggauucugggagaagagcaguacaaccgguaccagcaguauggugcagaggaguguguccugcagauggggggcguguuaugcccccgcccuggcuguggagcggggcugcugccggagccugaccagaggaaagucaccugcgaagggggcaauggccugggcuguggguuugccuucugccgggaauguaaagaagcguaccaugaaggggagugcagugccguauuugaagccucaggaacaacuacucaggccuacagagucgaugaaagagccgccgagcaggcucguugggaagcagccuccaaagaaaccaucaagaaaaccaccaagcccuguccccgcugccauguaccaguggaaaaaaauggaggcugcaugcacaugaaguguccgcagccccagugcaggcucgaguggugcuggaacuguggcugcgaguggaaccgcgucugcaugggggaccacugguucgacguguagccagggcggccgggcgccccaucgccacauccugggggagcauacccagugucuaccuucauuuucuaauucucuuuucaaacacacacacacacgcgcgcgcgcgcacacacacucuucaaguuuuuuucaaaguccaacuacagccaaauugcagaagaaacuccuggaucccuuucacuauguccaugaaaaacagcagaguaaaauuacagaagaagcuccugaaucccuuucaguuuguccacacaagacagcagagccaucugcgacaccaccaacaggcguucucagccuccggaugacacaaauaccagagcacagauucaagugcaauccauguaucuguaugggucauucucaccugaauucgagacaggcagaaucaguagcuggagagagaguucucacauuuaauauccugccuuuuaccuucaguaaacaccaugaagaugccauugacaagguguuucucuguaaaaugaacugcaguggguucuccaaacuagauucauggcuuuaacaguaauguucuuauuuaaauuuucagaaagcaucuauucccaaagaaccccaggcaauagucaaaaacauuuguuuauccuuaagaauuccaucuauauaaaucgcauuaaugaaauaccaacuaugcguaaaucaacuugucacaaagugagaaauuaugaaaguuaauuugaauguugaauguuugaauuacagggaagaaaucaaguuaauguacuuucauucccuuucaugauuugcaacuuuagaaagaaauuguuuuucugaaaguaucaccaaaaaaucuauaguuugauucugaguauucauuuugcaacuuggagauuuugcuaauacauuuggcuccacuguaaauuuaauagauaaagugccuauaaaggaaacacguuuagaaaugauuucaaaaugauauucaaucuuaacaaaagugaacauuauuaaaucagaaucuuuaaagaggagccuuuccagaacuaccaaaaugaagacacgcccgacucucuccaucagaaggguuuauaccccuuuggcacacccucucuguccaaucugcaagucccagggagcucugcauaccagggguuccccaggagagaccuucucuuaggacaguaaacucacuagaauauuccuuauguugacauggauuggauuucaguucaaucaaacuuucagcuuuuuuuucagccauucacaacacaaucaaaagauuaacaacacugcaugcggcaaaccgcaugcucuuacccacacuacgcagaagagaaaguacaaccacuaucuuuuguucuaccuguauugucugacuucucaggaagaucgugaacauaacugagggcaugagucucacuagcacauggaggcccuuuuggauuuagagacuguaaauuauuaaaucggcaacagggcuucucuuuuuagauguagcacugaaauccuugcuggagggaagagaggggaugaacucaaguuuuccacauccugggacaccugucccucuuuuccuaacugccuaagauaacccauuucuuccaaccaucugaggacagucccgucgucucagaggcccugcaccggggagagacugggcucugcagcagccacaucagcauucacagcuucauguggcuucacugucugaaaaucuaccgacuccaacauggccccacggugacaacagaccugugacaggaagcccaaagcucacauagaaaugguggacagaucaaagucucuauaguaagggaaaaaaagagagguggcaggcaugagcccccugcacccaguggcucguguccauacugaguccagacccugaucaaggccugacuuagugucacuggcagucccacuaaauuacacuuccuuacacuggcccgaugcgacaaaucagguggcucccuucugucacguggagcacacaguguuuuccaucauccauagcuuucuuccugaugguguuugcauuauugcgccuucccaaucugcaugcugcguugggcuugcggugccugaacaagguuugcucccaugagcucaggcacccuaggauccccuguuagacuauuaggcuguccagcauggucuccuuucccuucuuggugguggucuuuucccuuuccagaauagaacagugauucuuaaaauaaguuagagcaggccgggcgcgguggcucaugccuguaaucccagcacuuugggaggccgagguggguggaucacgaggucaggaguucaagaccagccuggccaagaugaugaaaccccgucucuauuaaaaauacaaaaauuagcugggcgugguggcaggcaccuguaaucccagcuuccugggaggcugaggcaggagaaucacuugaacccggggggcagagguugcagugagccgagaucacgccacugaacuccagccugggcaacagagugagacucugucucaaaaaaaaaaaaaaaacaaaaacaaaaaagcaagaucauccacuacacaugaacaugaaucacaguauuauuugcaca

SEQ ID NO: 166 - RNA, 3989 nt, Homo_Sapiens
auuccuagggccgggcgcgggggcggggaggccuggaggauuuaacccaggagagccgcuggugggaggcgcggcuggcgccgcugcgcgcaugggccuguuccuggcccgcagccgccaccuacccagugaccaugauaguguuugucagguucaacuccagccaugguuucccaguggaggucgauucugacaccagcaucuuccagcucaaggaggugguugcuaagcgacaggggguuccggcugaccaguugcgugugauuuucgcagggaaggagcugaggaaugacuggacugugcagaauugugaccuggaucagcagagcauuguucacauugugcagagaccguggagaaaaggucaagaaaugaaugcaacuggaggcgacgaccccagaaacgcggcgggaggcugugagcgggagccccagagcuugacucggguggaccucagcagcucaguccucccaggagacucuguggggcuggcugucauucugcacacugacagcaggaaggacucaccaccagcuggaaguccagcagguagaucaaucuacaacagcuuuuauguguauugcaaaggccccugucaaagagugcagccgggaaaacucaggguacagugcagcaccugcaggcaggcaacgcucaccuugacccaggaauuuuucuuuaaauguggagcacaccccaccucugacaaggaaacaucaguagcuuugcaccugaucgcaacaaauagucggaacaucacuugcauuacgugcacagacgucaggagccccguccugguuuuccagugcaacucccgccacgugauuugcuuagacuguuuccacuuauacugugugacaagacucaaugaucggcaguuuguucacgacccucaacuuggcuacucccugccuuguguggcuggcugucccaacuccuugauuaaagagcuccaucacuucaggauucugggagaagagcaguacaaccgguaccagcaguauggugcagaggaguguguccugcagauggggggcguguuaugcccccgcccuggcuguggagcggggcugcugccggagccugaccagaggaaagucaccugcgaagggggcaauggccugggcuguggguuugccuucugccgggaauguaaagaagcguaccaugaaggggagugcagugccguauuugaagccucaggaacaacuacucaggccuacagagucgaugaaagagccgccgagcaggcucguugggaagcagccuccaaagaaaccaucaagaaaaccaccaagcccuguccccgcugccauguaccaguggaaaaaaauggaggcugcaugcacaugaaguguccgcagccccagugcaggcucgaguggugcuggaacuguggcugcgaguggaaccgcgucugcaugggggaccacugguucgacguguagccagggcggccgggcgccccaucgccacauccugggggagcauacccagugucuaccuucauuuucuaauucucuuuucaaacacacacacacacgcgcgcgcgcgcacacacacucuucaaguuuuuuucaaaguccaacuacagccaaauugcagaagaaacuccuggaucccuuucacuauguccaugaaaaacagcagaguaaaauuacagaagaagcuccugaaucccuuucaguuuguccacacaagacagcagagccaucugcgacaccaccaacaggcguucucagccuccggaugacacaaauaccagagcacagauucaagugcaauccauguaucuguaugggucauucucaccugaauucgagacaggcagaaucaguagcuggagagagaguucucacauuuaauauccugccuuuuaccuucaguaaacaccaugaagaugccauugacaagguguuucucuguaaaaugaacugcaguggguucuccaaacuagauucauggcuuuaacaguaauguucuuauuuaaauuuucagaaagcaucuauucccaaagaaccccaggcaauagucaaaaacauuuguuuauccuuaagaauuccaucuauauaaaucgcauuaaugaaauaccaacuaugcguaaaucaacuugucacaaagugagaaauuaugaaaguuaauuugaauguugaauguuugaauuacagggaagaaaucaaguuaauguacuuucauucccuuucaugauuugcaacuuuagaaagaaauuguuuuucugaaaguaucaccaaaaaaucuauaguuugauucugaguauucauuuugcaacuuggagauuuugcuaauacauuuggcuccacuguaaauuuaauagauaaagugccuauaaaggaaacacguuuagaaaugauuucaaaaugauauucaaucuuaacaaaagugaacauuauuaaaucagaaucuuuaaagaggagccuuuccagaacuaccaaaaugaagacacgcccgacucucuccaucagaaggguuuauaccccuuuggcacacccucucuguccaaucugcaagucccagggagcucugcauaccagggguuccccaggagagaccuucucuuaggacaguaaacucacuagaauauuccuuauguugacauggauuggauuucaguucaaucaaacuuucagcuuuuuuuucagccauucacaacacaaucaaaagauuaacaacacugcaugcggcaaaccgcaugcucuuacccacacuacgcagaagagaaaguacaaccacuaucuuuuguucuaccuguauugucugacuucucaggaagaucgugaacauaacugagggcaugagucucacuagcacauggaggcccuuuuggauuuagagacuguaaauuauuaaaucggcaacagggcuucucuuuuuagauguagcacugaaauccuugcuggagggaagagaggggaugaacucaaguuuuccacauccugggacaccugucccucuuuuccuaacugccuaagauaacccauuucuuccaaccaucugaggacagucccgucgucucagaggcccugcaccggggagagacugggcucugcagcagccacaucagcauucacagcuucauguggcuucacugucugaaaaucuaccgacuccaacauggccccacggugacaacagaccugugacaggaagcccaaagcucacauagaaaugguggacagaucaaagucucuauaguaagggaaaaaaagagagguggcaggcaugagcccccugcacccaguggcucguguccauacugaguccagacccugaucaaggccugacuuagugucacuggcagucccacuaaauuacacuuccuuacacuggcccgaugcgacaaaucagguggcucccuucugucacguggagcacacaguguuuuccaucauccauagcuuucuuccugaugguguuugcauuauugcgccuucccaaucugcaugcugcguugggcuugcggugccugaacaagguuugcucccaugagcucaggcacccuaggauccccuguuagacuauuaggcuguccagcauggucuccuuucccuucuuggugguggucuuuucccuuuccagaauagaacagugauucuuaaaauaaguuagagcaggccgggcgcgguggcucaugccuguaaucccagcacuuugggaggccgagguggguggaucacgaggucaggaguucaagaccagccuggccaagaugaugaaaccccgucucuauuaaaaauacaaaaauuagcugggcgugguggcaggcaccuguaaucccagcuuccugggaggcugaggcaggagaaucacuugaacccggggggcagagguugcagugagccgagaucacgccacugaacuccagccugggcaacagagugagacucugucucaaaaaaaaaaaaaaaacaaaaacaaaaaagcaagaucauccacuacacaugaacaugaaucacaguauuauuugcaca

SEQ ID NO: 167 - RNA, 3626 nt, Homo_Sapiens
auuccuagggccgggcgcgggggcggggaggccuggaggauuuaacccaggagagccgcuggugggaggcgcggcuggcgccgcugcgcgcaugggccuguuccuggcccgcagccgccaccuacccagugaccaugauaguguuugucagguucaacuccagccaugguuucccaguggaggucgauucugacaccagcaucuuccagcucaaggaggugguugcuaagcgacaggggguuccggcugaccaguugcgugugauuuucgcagggaaggagcugaggaaugacuggacugugcaggaauuuuucuuuaaauguggagcacaccccaccucugacaaggaaacaucaguagcuuugcaccugaucgcaacaaauagucggaacaucacuugcauuacgugcacagacgucaggagccccguccugguuuuccagugcaacucccgccacgugauuugcuuagacuguuuccacuuauacugugugacaagacucaaugaucggcaguuuguucacgacccucaacuuggcuacucccugccuuguguggcuggcugucccaacuccuugauuaaagagcuccaucacuucaggauucugggagaagagcaguacaaccgguaccagcaguauggugcagaggaguguguccugcagauggggggcguguuaugcccccgcccuggcuguggagcggggcugcugccggagccugaccagaggaaagucaccugcgaagggggcaauggccugggcuguggguuugccuucugccgggaauguaaagaagcguaccaugaaggggagugcagugccguauuugaagccucaggaacaacuacucaggccuacagagucgaugaaagagccgccgagcaggcucguugggaagcagccuccaaagaaaccaucaagaaaaccaccaagcccuguccccgcugccauguaccaguggaaaaaaauggaggcugcaugcacaugaaguguccgcagccccagugcaggcucgaguggugcuggaacuguggcugcgaguggaaccgcgucugcaugggggaccacugguucgacguguagccagggcggccgggcgccccaucgccacauccugggggagcauacccagugucuaccuucauuuucuaauucucuuuucaaacacacacacacacgcgcgcgcgcgcacacacacucuucaaguuuuuuucaaaguccaacuacagccaaauugcagaagaaacuccuggaucccuuucacuauguccaugaaaaacagcagaguaaaauuacagaagaagcuccugaaucccuuucaguuuguccacacaagacagcagagccaucugcgacaccaccaacaggcguucucagccuccggaugacacaaauaccagagcacagauucaagugcaauccauguaucuguaugggucauucucaccugaauucgagacaggcagaaucaguagcuggagagagaguucucacauuuaauauccugccuuuuaccuucaguaaacaccaugaagaugccauugacaagguguuucucuguaaaaugaacugcaguggguucuccaaacuagauucauggcuuuaacaguaauguucuuauuuaaauuuucagaaagcaucuauucccaaagaaccccaggcaauagucaaaaacauuuguuuauccuuaagaauuccaucuauauaaaucgcauuaaugaaauaccaacuaugcguaaaucaacuugucacaaagugagaaauuaugaaaguuaauuugaauguugaauguuugaauuacagggaagaaaucaaguuaauguacuuucauucccuuucaugauuugcaacuuuagaaagaaauuguuuuucugaaaguaucaccaaaaaaucuauaguuugauucugaguauucauuuugcaacuuggagauuuugcuaauacauuuggcuccacuguaaauuuaauagauaaagugccuauaaaggaaacacguuuagaaaugauuucaaaaugauauucaaucuuaacaaaagugaacauuauuaaaucagaaucuuuaaagaggagccuuuccagaacuaccaaaaugaagacacgcccgacucucuccaucagaaggguuuauaccccuuuggcacacccucucuguccaaucugcaagucccagggagcucugcauaccagggguuccccaggagagaccuucucuuaggacaguaaacucacuagaauauuccuuauguugacauggauuggauuucaguucaaucaaacuuucagcuuuuuuuucagccauucacaacacaaucaaaagauuaacaacacugcaugcggcaaaccgcaugcucuuacccacacuacgcagaagagaaaguacaaccacuaucuuuuguucuaccuguauugucugacuucucaggaagaucgugaacauaacugagggcaugagucucacuagcacauggaggcccuuuuggauuuagagacuguaaauuauuaaaucggcaacagggcuucucuuuuuagauguagcacugaaauccuugcuggagggaagagaggggaugaacucaaguuuuccacauccugggacaccugucccucuuuuccuaacugccuaagauaacccauuucuuccaaccaucugaggacagucccgucgucucagaggcccugcaccggggagagacugggcucugcagcagccacaucagcauucacagcuucauguggcuucacugucugaaaaucuaccgacuccaacauggccccacggugacaacagaccugugacaggaagcccaaagcucacauagaaaugguggacagaucaaagucucuauaguaagggaaaaaaagagagguggcaggcaugagcccccugcacccaguggcucguguccauacugaguccagacccugaucaaggccugacuuagugucacuggcagucccacuaaauuacacuuccuuacacuggcccgaugcgacaaaucagguggcucccuucugucacguggagcacacaguguuuuccaucauccauagcuuucuuccugaugguguuugcauuauugcgccuucccaaucugcaugcugcguugggcuugcggugccugaacaagguuugcucccaugagcucaggcacccuaggauccccuguuagacuauuaggcuguccagcauggucuccuuucccuucuuggugguggucuuuucccuuuccagaauagaacagugauucuuaaaauaaguuagagcaggccgggcgcgguggcucaugccuguaaucccagcacuuugggaggccgagguggguggaucacgaggucaggaguucaagaccagccuggccaagaugaugaaaccccgucucuauuaaaaauacaaaaauuagcugggcgugguggcaggcaccuguaaucccagcuuccugggaggcugaggcaggagaaucacuugaacccggggggcagagguugcagugagccgagaucacgccacugaacuccagccugggcaacagagugagacucugucucaaaaaaaaaaaaaaaacaaaaacaaaaaagcaagaucauccacuacacaugaacaugaaucacaguauuauuugcaca

SEQ ID NO: 168 - RNA, 13481 nt, Homo_Sapiens
gcugccgggacggguccaagauggacggccgcucagguucugcuuuuaccugcggcccagagccccauucauugccccggugcugagcggcgccgcgagucggcccgaggccuccggggacugccgugccgggcgggagaccgccauggcgacccuggaaaagcugaugaaggccuucgagucccucaaguccuuccagcagcagcagcagcagcagcagcagcagcagcagcagcagcagcagcagcagcagcagcagcaacagccgccaccgccgccgccgccgccgccgccuccucagcuuccucagccgccgccgcaggcacagccgcugcugccucagccgcagccgcccccgccgccgcccccgccgccacccggcccggcuguggcugaggagccgcugcaccgaccaaagaaagaacuuucagcuaccaagaaagaccgugugaaucauugucugacaauaugugaaaacauaguggcacagucugucagaaauucuccagaauuucagaaacuucugggcaucgcuauggaacuuuuucugcugugcagugaugacgcagagucagaugucaggaugguggcugacgaaugccucaacaaaguuaucaaagcuuugauggauucuaaucuuccaagguuacagcucgagcucuauaaggaaauuaaaaagaauggugccccucggaguuugcgugcugcccuguggagguuugcugagcuggcucaccugguucggccucagaaaugcaggccuuaccuggugaaccuucugccgugccugacucgaacaagcaagagacccgaagaaucaguccaggagaccuuggcugcagcuguucccaaaauuauggcuucuuuuggcaauuuugcaaaugacaaugaaauuaagguuuuguuaaaggccuucauagcgaaccugaagucaagcucccccaccauucggcggacagcggcuggaucagcagugagcaucugccagcacucaagaaggacacaauauuucuauaguuggcuacuaaaugugcucuuaggcuuacucguuccugucgaggaugaacacuccacucugcugauucuuggcgugcugcucacccugagguauuuggugcccuugcugcagcagcaggucaaggacacaagccugaaaggcagcuucggagugacaaggaaagaaauggaagucucuccuucugcagagcagcuuguccagguuuaugaacugacguuacaucauacacagcaccaagaccacaauguugugaccggagcccuggagcuguugcagcagcucuucagaacgccuccacccgagcuucugcaaacccugaccgcagucgggggcauugggcagcucaccgcugcuaaggaggagucugguggccgaagccguagugggaguauuguggaacuuauagcuggaggggguuccucaugcagcccuguccuuucaagaaaacaaaaaggcaaagugcucuuaggagaagaagaagccuuggaggaugacucugaaucgagaucggaugucagcagcucugccuuaacagccucagugaaggaugagaucaguggagagcuggcugcuucuucagggguuuccacuccagggucagcaggucaugacaucaucacagaacagccacggucacagcacacacugcaggcggacucaguggaucuggccagcugugacuugacaagcucugccacugauggggaugaggaggauaucuugagccacagcuccagccaggucagcgccgucccaucugacccugccauggaccugaaugaugggacccaggccucgucgcccaucagcgacagcucccagaccaccaccgaagggccugauucagcuguuaccccuucagacaguucugaaauuguguuagacgguaccgacaaccaguauuugggccugcagauuggacagccccaggaugaagaugaggaagccacagguauucuuccugaugaagccucggaggccuucaggaacucuuccauggcccuucaacaggcacauuuauugaaaaacaugagucacugcaggcagccuucugacagcaguguugauaaauuuguguugagagaugaagcuacugaaccgggugaucaagaaaacaagccuugccgcaucaaaggugacauuggacaguccacugaugaugacucugcaccucuuguccauuguguccgccuuuuaucugcuucguuuuugcuaacagggggaaaaaaugugcugguuccggacagggaugugagggucagcgugaaggcccuggcccucagcugugugggagcagcuguggcccuccacccggaaucuuucuucagcaaacucuauaaaguuccucuugacaccacggaauacccugaggaacaguaugucucagacaucuugaacuacaucgaucauggagacccacagguucgaggagccacugccauucucugugggacccucaucugcuccauccucagcaggucccgcuuccacgugggagauuggaugggcaccauuagaacccucacaggaaauacauuuucuuuggcggauugcauuccuuugcugcggaaaacacugaaggaugagucuucuguuacuugcaaguuagcuuguacagcugugaggaacugugucaugagucucugcagcagcagcuacagugaguuaggacugcagcugaucaucgaugugcugacucugaggaacaguuccuauuggcuggugaggacagagcuucuggaaacccuugcagagauugacuucaggcuggugagcuuuuuggaggcaaaagcagaaaacuuacacagaggggcucaucauuauacagggcuuuuaaaacugcaagaacgagugcucaauaauguugucauccauuugcuuggagaugaagaccccagggugcgacauguugccgcagcaucacuaauuaggcuugucccaaagcuguuuuauaaaugugaccaaggacaagcugauccaguaguggccguggcaagagaucaaagcaguguuuaccugaaacuucucaugcaugagacgcagccuccaucucauuucuccgucagcacaauaaccagaauauauagaggcuauaaccuacuaccaagcauaacagacgucacuauggaaaauaaccuuucaagaguuauugcagcaguuucucaugaacuaaucacaucaaccaccagagcacucacauuuggaugcugugaagcuuugugucuucuuuccacugccuucccaguuugcauuuggaguuuagguuggcacuguggagugccuccacugagugccucagaugagucuaggaagagcuguaccguugggauggccacaaugauucugacccugcucucgucagcuugguucccauuggaucucucagcccaucaagaugcuuugauuuuggccggaaacuugcuugcagccagugcucccaaaucucugagaaguucaugggccucugaagaagaagccaacccagcagccaccaagcaagaggaggucuggccagcccugggggaccgggcccuggugcccaugguggagcagcucuucucucaccugcugaaggugauuaacauuugugcccacguccuggaugacguggcuccuggacccgcaauaaaggcagccuugccuucucuaacaaaccccccuucucuaagucccauccgacgaaaggggaaggagaaagaaccaggagaacaagcaucuguaccguugagucccaagaaaggcagugaggccagugcagcuucuagacaaucugauaccucagguccuguuacaacaaguaaauccucaucacuggggaguuucuaucaucuuccuucauaccucaaacugcaugauguccugaaagcuacacacgcuaacuacaaggucacgcuggaucuucagaacagcacggaaaaguuuggaggguuucuccgcucagccuuggauguucuuucucagauacuagagcuggccacacugcaggacauugggaaguguguugaagagauccuaggauaccugaaauccugcuuuagucgagaaccaaugauggcaacuguuuguguucaacaauuguugaagacucucuuuggcacaaacuuggccucccaguuugauggcuuaucuuccaaccccagcaagucacaaggccgagcacagcgccuuggcuccuccagugugaggccaggcuuguaccacuacugcuucauggccccguacacccacuucacccaggcccucgcugacgccagccugaggaacauggugcaggcggagcaggagaacgacaccucgggaugguuugauguccuccagaaagugucuacccaguugaagacaaaccucacgagugucacaaagaaccgugcagauaagaaugcuauucauaaucacauucguuuguuugaaccucuuguuauaaaagcuuuaaaacaguacacgacuacaacaugugugcaguuacagaagcagguuuuagauuugcuggcgcagcugguucaguuacggguuaauuacugucuucuggauucagaucagguguuuauuggcuuuguauugaaacaguuugaauacauugaagugggccaguucagggaaucagaggcaaucauuccaaacaucuuuuucuucuugguauuacuaucuuaugaacgcuaucauucaaaacagaucauuggaauuccuaaaaucauucagcucugugauggcaucauggccaguggaaggaaggcugugacacaugccauaccggcucugcagcccauaguccacgaccucuuuguauuaagaggaacaaauaaagcugaugcaggaaaagagcuugaaacccaaaaagaggugguggugucaauguuacugagacucauccaguaccaucagguguuggagauguucauucuuguccugcagcagugccacaaggagaaugaagacaaguggaagcgacugucucgacagauagcugacaucauccucccaauguuagccaaacagcagaugcacauugacucucaugaagcccuuggaguguuaaauacauuauuugagauuuuggccccuuccucccuccguccgguagacaugcuuuuacggaguauguucgucacuccaaacacaauggcguccgugagcacuguucaacuguggauaucgggaauucuggccauuuugaggguucugauuucccagucaacugaagauauuguucuuucucguauucaggagcucuccuucucuccguauuuaaucuccuguacaguaauuaauagguuaagagauggggacaguacuucaacgcuagaagaacacagugaagggaaacaaauaaagaauuugccagaagaaacauuuucaagguuucuauuacaacugguugguauucuuuuagaagacauuguuacaaaacagcugaagguggaaaugagugagcagcaacauacuuucuauugccaggaacuaggcacacugcuaaugugucugauccacaucuucaagucuggaauguuccggagaaucacagcagcugccacuaggcuguuccgcagugauggcuguggcggcaguuucuacacccuggacagcuugaacuugcgggcucguuccaugaucaccacccacccggcccuggugcugcucuggugucagauacugcugcuugucaaccacaccgacuaccgcuggugggcagaagugcagcagaccccgaaaagacacagucuguccagcacaaaguuacuuaguccccagaugucuggagaagaggaggauucugacuuggcagccaaacuuggaaugugcaauagagaaauaguacgaagaggggcucucauucucuucugugauuaugucugucagaaccuccaugacuccgagcacuuaacguggcucauuguaaaucacauucaagaucugaucagccuuucccacgagccuccaguacaggacuucaucagugccguucaucggaacucugcugccagcggccuguucauccaggcaauucagucucguugugaaaaccuuucaacuccaaccaugcugaagaaaacucuucagugcuuggaggggauccaucucagccagucgggagcugugcucacgcuguauguggacaggcuucugugcaccccuuuccgugugcuggcucgcauggucgacauccuugcuugucgccggguagaaaugcuucuggcugcaaauuuacagagcagcauggcccaguugccaauggaagaacucaacagaauccaggaauaccuucagagcagcgggcucgcucagagacaccaaaggcucuauucccugcuggacagguuucgucucuccaccaugcaagacucacuuagucccucuccuccagucucuucccacccgcuggacggggaugggcacgugucacuggaaacagugaguccggacaaagacugguacguucaucuugucaaaucccaguguuggaccaggucagauucugcacugcuggaaggugcagagcuggugaaucggauuccugcugaagauaugaaugccuucaugaugaacucggaguucaaccuaagccugcuagcuccaugcuuaagccuagggaugagugaaauuucugguggccagaagagugcccuuuuugaagcagcccgugaggugacucuggcccgugugagcggcaccgugcagcagcucccugcuguccaucaugucuuccagcccgagcugccugcagagccggcggccuacuggagcaaguugaaugaucuguuuggggaugcugcacuguaucagucccugcccacucuggcccgggcccuggcacaguaccuggugguggucuccaaacugcccagucauuugcaccuuccuccugagaaagagaaggacauugugaaauucgugguggcaacccuugaggcccuguccuggcauuugauccaugagcagaucccgcugagucuggaucuccaggcagggcuggacugcugcugccuggcccugcagcugccuggccucuggagcguggucuccuccacagaguuugugacccacgccugcucccucaucuacugugugcacuucauccuggaggccguugcagugcagccuggagagcagcuucuuaguccagaaagaaggacaaauaccccaaaagccaucagcgaggaggaggaggaaguagauccaaacacacagaauccuaaguauaucacugcagccugugagaugguggcagaaaugguggagucucugcagucgguguuggccuugggucauaaaaggaauagcggcgugccggcguuucucacgccauugcuaaggaacaucaucaucagccuggcccgccugccccuugucaacagcuacacacgugugcccccacugguguggaagcuuggauggucacccaaaccgggaggggauuuuggcacagcauucccugagauccccguggaguuccuccaggaaaaggaagucuuuaaggaguucaucuaccgcaucaacacacuaggcuggaccagucguacucaguuugaagaaacuugggccacccuccuugguguccuggugacgcagccccucgugauggagcaggaggagagcccaccagaagaagacacagagaggacccagaucaacguccuggccgugcaggccaucaccucacuggugcucagugcaaugacugugccuguggccggcaacccagcuguaagcugcuuggagcagcagccccggaacaagccucugaaagcucucgacaccagguuugggaggaagcugagcauuaucagagggauuguggagcaagagauucaagcaaugguuucaaagagagagaauauugccacccaucauuuauaucaggcaugggauccugucccuucucugucuccggcuacuacaggugcccucaucagccacgagaagcugcugcuacagaucaaccccgagcgggagcuggggagcaugagcuacaaacucggccagguguccauacacuccguguggcuggggaacagcaucacaccccugagggaggaggaaugggacgaggaagaggaggaggaggccgacgccccugcaccuucgucaccacccacgucuccagucaacuccaggaaacaccgggcuggaguugacauccacuccuguucgcaguuuuugcuugaguuguacagccgcuggauccugccguccagcucagccaggaggaccccggccauccugaucagugagguggucagaucccuucuaguggucucagacuuguucaccgagcgcaaccaguuugagcugauguaugugacgcugacagaacugcgaagggugcacccuucagaagacgagauccucgcucaguaccuggugccugccaccugcaaggcagcugccguccuugggauggacaaggccguggcggagccugucagccgccugcuggagagcacgcucaggagcagccaccugcccagcaggguuggagcccugcacggcguccucuaugugcuggagugcgaccugcuggacgacacugccaagcagcucaucccggucaucagcgacuaucuccucuccaaccugaaagggaucgcccacugcgugaacauucacagccagcagcacguacuggucaugugugccacugcguuuuaccucauugagaacuauccucuggacguagggccggaauuuucagcaucaauaauacagauguguggggugaugcugucuggaagugaggaguccacccccuccaucauuuaccacugugcccucagaggccuggagcgccuccugcucucugagcagcucucccgccuggaugcagaaucgcuggucaagcugaguguggacagagugaacgugcacagcccgcaccgggccauggcggcucugggccugaugcucaccugcauguacacaggaaaggagaaagucaguccggguagaacuucagacccuaauccugcagcccccgacagcgagucagugauuguugcuauggagcggguaucuguucuuuuugauaggaucaggaaaggcuuuccuugugaagccagagugguggccaggauccugccccaguuucuagacgacuucuucccaccccaggacaucaugaacaaagucaucggagaguuucuguccaaccagcagccauacccccaguucauggccaccgugguguauaagguguuucagacucugcacagcaccgggcagucguccaugguccgggacugggucaugcugucccucuccaacuucacgcagagggccccggucgccauggccacguggagccucuccugcuucuuugucagcgcguccaccagcccgugggucgcggcgauccucccacaugucaucagcaggaugggcaagcuggagcagguggacgugaaccuuuucugccuggucgccacagacuucuacagacaccagauagaggaggagcucgaccgcagggccuuccagucugugcuugaggugguugcagccccaggaagcccauaucaccggcugcugacuuguuuacgaaauguccacaaggucaccaccugcugagcgccauggugggagagacugugaggcggcagcuggggccggagccuuuggaagucugcgcccuugugcccugccuccaccgagccagcuuggucccuaugggcuuccgcacaugccgcgggcggccaggcaacgugcgugucucugccauguggcagaagugcucuuuguggcaguggccaggcagggagugucugcaguccugguggggcugagccugaggccuuccagaaagcaggagcagcugugcugcaccccaugugggugaccagguccuuucuccugauagucaccugcugguuguugccagguugcagcugcucuugcaucugggccagaaguccucccuccugcaggcuggcuguuggccccucugcuguccugcaguagaaggugccgugagcaggcuuugggaacacuggccugggucucccugguggggugugcaugccacgccccgugucuggaugcacagaugccauggccugugcugggccaguggcugggggugcuagacacccggcaccauucucccuucucucuuuucuucucaggauuuaaaauuuaauuauaucaguaaagagauuaauuuuaacguaacucuuucuaugcccguguaaaguaugugaaucgcaaggccugugcugcaugcgacagcguccggggugguggacagggcccccggccacgcucccucuccuguagccacuggcauagcccuccugagcacccgcugacauuuccguuguacauguuccuguuuaugcauucacaaggugacugggauguagagaggcguuagugggcagguggccacagcaggacugaggacaggcccccauuauccuaggggugcgcucaccugcagccccuccuccucgggcacagacgacugucguucuccacccaccagucagggacagcagccucccugucacucagcugagaaggccagcccucccuggcugugagcagccuccacuguguccagagacaugggccucccacuccuguuccuugcuagcccugggguggcgucugccuaggagcuggcuggcagguguugggaccugcugcuccauggaugcaugcccuaagagugucacugagcuguguuuugucugagccucucucggucaacagcaaagcuuggugucuuggcacuguuagugacagagcccagcaucccuucugcccccguuccagcugacaucuugcacggugaccccuuuuagucaggagagugcagaucugugcucaucggagacugccccacggcccugucagagccgccacuccuauccccaggccaggucccuggaccagccuccuguuugcaggcccagaggagccaagucauuaaaauggaaguggauucuggauggccgggcugcugcugauguaggagcuggauuugggagcucugcuugccgacuggcugugagacgaggcaggggcucugcuuccucagcccuagaggcgagccaggcaagguuggcgacugucauguggcuugguuuggucaugcccgucgauguuuuggguauugaaugugguaaguggaggaaauguuggaacucugugcaggugcugccuugagacccccaagcuuccaccugucccucuccuauguggcagcuggggagcagcugagauguggacuuguaugcugcccacauacgugagggggagcugaaagggagccccuccucugagcagccucugccaggccuguaugaggcuuuucccaccagcucccaacagaggccucccccagccaggaccaccucguccucguggcggggcagcaggagcgguagaaagggguccgauguuugaggaggcccuuaagggaagcuacugaauuauaacacguaagaaaaucaccauuccguauugguugggggcuccuguuucucauccuagcuuuuuccuggaaagcccgcuagaagguuugggaacgaggggaaaguucucagaacuguuggcugcuccccacccgccucccgccucccccgcagguuaugucagcagcucugagacagcaguaucacaggccagauguuguuccuggcuagauguuuacauuuguaagaaauaacacugugaauguaaaacagagccauucccuuggaaugcauaucgcugggcucaacauagaguuugucuuccucuuguuuacgacgugaucuaaaccaguccuuagcaaggggcucagaacaccccgcucuggcaguaggugucccccacccccaaagaccugccugugugcuccggagaugaauaugagcucauuaguaaaaaugacuucacccacgcauauacauaaaguauccaugcaugugcauauagacacaucuauaauuuuacacacacaccucucaagacggagaugcauggccucuaagagugcccgugucgguucuuccuggaaguugacuuuccuuagacccgccaggucaaguuagccgcgugacggacauccaggcgugggacguggucagggcagggcucauucauugcccacuaggaucccacuggcgaagauggucuccauaucagcucucugcagaagggaggaagacuuuaucauguuccuaaaaaucuguggcaagcacccaucguauuauccaaauuuuguugcaaaugugauuaauuugguugucaaguuuugggggugggcuguggggagauugcuuuuguuuuccugcugguaauaucgggaaagauuuuaaugaaaccaggguagaauuguuuggcaaugcacugaagcguguuucuuucccaaaaugugccucccuuccgcugcgggcccagcugagucuauguaggugauguuuccagcugccaagugcucuuuguuacuguccacccucauuucugccagcgcauguguccuuucaaggggaaaaugugaagcugaacccccuccagacacccagaauguagcaucugagaaggcccugugcccuaaaggacaccccucgcccccaucuucauggagggggucauuucagagcccucggagccaaugaacagcuccuccucuuggagcugagaugagccccacguggagcucgggacggauaguagacagcaauaacucgguguguggccgccuggcagguggaacuuccucccguugcgggguggagugagguuaguucugugugucugguggguggagucaggcuucucuugcuaccugugagcauccuucccagcagacauccucaucgggcuuugucccucccccgcuuccucccucugcggggaggacccgggaccacagcugcuggccaggguagacuuggagcuguccuccagaggggucacguguaggagugagaagaaggaagaucuugagagcugcugagggaccuuggagagcucaggauggcucagacgaggacacucgcuugccgggccugggccuccugggaaggagggagcugcucagaaugccgcaugacaacugaaggcaaccuggaagguucaggggccgcucuucccccaugugccugucacgcucuggugcagucaaaggaacgccuuccccucaguuguuucuaagagcagagucucccgcugcaaucugggugguaacugccagccuuggaggaucguggccaacguggaccugccuacggagggugggcucugacccaaguggggccuccuuguccaggucucacugcuuugcaccguggucagagggacugucagcugagcuugagcuccccuggagccagcagggcugugaugggcgagucccggagccccacccagaccugaaugcuucugagagcaaagggaaggacugacgagagauguauauuuaauuuuuuaacugcugcaaacauuguacauccaaauuaaaggaaaaaaauggaaaccauca

SEQ ID NO: 169 - RNA, 4871 nt, Homo_Sapiens
agucccugcccuccccuggggagggugagucacgccaaacugggcggagaguccgcuggccucacuccuagcucaucugggcggcggcggcaaguggggacagggcggguggcgcaucaccggcgcggaggcaggaggagcagucucauuguuccgggagccgucaccacaguaggucccucggcucagucggcccagccccucucaguccuccccaacccccacaaccgcccgcggcucugagacgcggccccggcggcggcggcagcagcugcagcaucaucuccacccuccagccauggaagaccuggaccagucuccucuggucucguccucggacagcccaccccggccgcagcccgcguucaaguaccaguucgugagggagcccgaggacgaggaggaagaagaggaggaggaagaggaggacgaggacgaagaccuggaggagcuggaggugcuggagaggaagcccgccgccgggcuguccgcggccccagugcccaccgccccugccgccggcgcgccccugauggacuucggaaaugacuucgugccgccggcgccccggggaccccugccggccgcuccccccgucgccccggagcggcagccgucuugggacccgagcccggugucgucgaccgugcccgcgccauccccgcugucugcugccgcagucucgcccuccaagcucccugaggacgacgagccuccggcccggccucccccuccucccccggccagcgugagcccccaggcagagcccguguggaccccgccagccccggcucccgccgcgccccccuccaccccggccgcgcccaagcgcaggggcuccucgggcucaguggaugagacccuuuuugcucuuccugcugcaucugagccugugauacgcuccucugcagaaaauauggacuugaaggagcagccagguaacacuauuucggcuggucaagaggauuucccaucuguccugcuugaaacugcugcuucucuuccuucucugucuccucucucagccgcuucuuucaaagaacaugaauaccuugguaauuugucaacaguauuacccacugaaggaacacuucaagaaaaugucagugaagcuucuaaagaggucucagagaaggcaaaaacucuacucauagauagagauuuaacagaguuuucagaauuagaauacucagaaaugggaucaucguucagugucucuccaaaagcagaaucugccguaauaguagcaaauccuagggaagaaauaaucgugaaaaauaaagaugaagaagagaaguuaguuaguaauaacauccuucauaaucaacaagaguuaccuacagcucuuacuaaauugguuaaagaggaugaaguugugucuucagaaaaagcaaaagacaguuuuaaugaaaagagaguugcaguggaagcuccuaugagggaggaauaugcagacuucaaaccauuugagcgaguaugggaagugaaagauaguaaggaagauagugauauguuggcugcuggagguaaaaucgagagcaacuuggaaaguaaaguggauaaaaaauguuuugcagauagccuugagcaaacuaaucacgaaaaagauagugagaguaguaaugaugauacuucuuuccccaguacgccagaagguauaaaggaucguucaggagcauauaucacaugugcucccuuuaacccagcagcaacugagagcauugcaacaaacauuuuuccuuuguuaggagauccuacuucagaaaauaagaccgaugaaaaaaaaauagaagaaaagaaggcccaaauaguaacagagaagaauacuagcaccaaaacaucaaacccuuuucuuguagcagcacaggauucugagacagauuaugucacaacagauaauuuaacaaaggugacugaggaagucguggcaaacaugccugaaggccugacuccagauuuaguacaggaagcaugugaaagugaauugaaugaaguuacugguacaaagauugcuuaugaaacaaaaauggacuugguucaaacaucagaaguuaugcaagagucacucuauccugcagcacagcuuugcccaucauuugaagagucagaagcuacuccuucaccaguuuugccugacauuguuauggaagcaccauugaauucugcaguuccuagugcuggugcuuccgugauacagcccagcucaucaccauuagaagcuucuucaguuaauuaugaaagcauaaaacaugagccugaaaaccccccaccauaugaagaggccaugaguguaucacuaaaaaaaguaucaggaauaaaggaagaaauuaaagagccugaaaauauuaaugcagcucuucaagaaacagaagcuccuuauauaucuauugcaugugauuuaauuaaagaaacaaagcuuucugcugaaccagcuccggauuucucugauuauucagaaauggcaaaaguugaacagccagugccugaucauucugagcuaguugaagauuccucaccugauucugaaccaguugacuuauuuagugaugauucaauaccugacguuccacaaaaacaagaugaaacugugaugcuugugaaagaaagucucacugagacuucauuugagucaaugauagaauaugaaaauaaggaaaaacucagugcuuugccaccugagggaggaaagccauauuuggaaucuuuuaagcucaguuuagauaacacaaaagauacccuguuaccugaugaaguuucaacauugagcaaaaaggagaaaauuccuuugcagauggaggagcucaguacugcaguuuauucaaaugaugacuuauuuauuucuaaggaagcacagauaagagaaacugaaacguuuucagauucaucuccaauugaaauuauagaugaguucccuacauugaucaguucuaaaacugauucauuuucuaaauuagccagggaauauacugaccuagaaguaucccacaaaagugaaauugcuaaugccccggauggagcugggucauugccuugcacagaauugccccaugaccuuucuuugaagaacauacaacccaaaguugaagagaaaaucaguuucucagaugacuuuucuaaaaaugggucugcuacaucaaaggugcucuuauugccuccagauguuucugcuuuggccacucaagcagagauagagagcauaguuaaacccaaaguucuugugaaagaagcugagaaaaaacuuccuuccgauacagaaaaagaggacagaucaccaucugcuauauuuucagcagagcugaguaaaacuucaguuguugaccuccuguacuggagagacauuaagaagacuggagugguguuuggugccagccuauuccugcugcuuucauugacaguauucagcauugugagcguaacagccuacauugccuuggcccugcucucugugaccaucagcuuuaggauauacaagggugugauccaagcuauccagaaaucagaugaaggccacccauucagggcauaucuggaaucugaaguugcuauaucugaggaguugguucagaaguacaguaauucugcucuuggucaugugaacugcacgauaaaggaacucaggcgccucuucuuaguugaugauuuaguugauucucugaaguuugcaguguugauguggguauuuaccuauguuggugccuuguuuaauggucugacacuacugauuuuggcucucauuucacucuucaguguuccuguuauuuaugaacggcaucaggcacagauagaucauuaucuaggacuugcaaauaagaauguuaaagaugcuauggcuaaaauccaagcaaaaaucccuggauugaagcgcaaagcugaaugaaaacgcccaaaauaauuaguaggaguucaucuuuaaaggggauauucauuugauuauacgggggagggucagggaagaacgaaccuugacguugcagugcaguuucacagaucguuguuagaucuuuauuuuuagccaugcacuguugugaggaaaaauuaccugucuugacugccauguguucaucaucuuaaguauuguaagcugcuauguauggauuuaaaccguaaucauaucuuuuuccuaucuaucugaggcacugguggaauaaaaaaccuguauauuuuacuuuguugcagauagucuugccgcaucuuggcaaguugcagagaugguggagcuagaaaaaaaaaaaaaaaagcccuuuucaguuugugcacuguguaugguccguguagauugaugcagauuuucugaaaugaaauguuuguuuagacgagaucauaccgguaaagcaggaaugacaaagcuugcuuuucugguauguucuagguguauugugacuuuuacuguuauauuaauugccaauauaaguaaauauagauuauauauguauaguguuucacaaagcuuagaccuuuaccuuccagccaccccacagugcuugauauuucagagucagucauugguuauacauguguaguuccaaagcacauaagcuagaagaagaaauauuucuaggagcacuaccaucuguuuucaacaugaaaugccacacacauagaacuccaacaucaauuucauugcacagacugacuguaguuaauuuugucacagaaucuauggacugaaucuaaugcuuccaaaaauguuguuuguuugcaaauaucaaacauuguuaugcaagaaauuauuaauuacaaaaugaagauuuauaccauugugguuuaagcuguacugaacuaaaucuguggaaugcauugugaacuguaaaagcaaaguaucaauaaagcuuauagacuuaaaaaaaaaaaaaaaaaaaaaaaaaaaaaaa

SEQ ID NO: 170 - RNA, 2414 nt, Homo_Sapiens
agucccugcccuccccuggggagggugagucacgccaaacugggcggagaguccgcuggccucacuccuagcucaucugggcggcggcggcaaguggggacagggcggguggcgcaucaccggcgcggaggcaggaggagcagucucauuguuccgggagccgucaccacaguaggucccucggcucagucggcccagccccucucaguccuccccaacccccacaaccgcccgcggcucugagacgcggccccggcggcggcggcagcagcugcagcaucaucuccacccuccagccauggaagaccuggaccagucuccucuggucucguccucggacagcccaccccggccgcagcccgcguucaaguaccaguucgugagggagcccgaggacgaggaggaagaagaggaggaggaagaggaggacgaggacgaagaccuggaggagcuggaggugcuggagaggaagcccgccgccgggcuguccgcggccccagugcccaccgccccugccgccggcgcgccccugauggacuucggaaaugacuucgugccgccggcgccccggggaccccugccggccgcuccccccgucgccccggagcggcagccgucuugggacccgagcccggugucgucgaccgugcccgcgccauccccgcugucugcugccgcagucucgcccuccaagcucccugaggacgacgagccuccggcccggccucccccuccucccccggccagcgugagcccccaggcagagcccguguggaccccgccagccccggcucccgccgcgccccccuccaccccggccgcgcccaagcgcaggggcuccucgggcucagugguuguugaccuccuguacuggagagacauuaagaagacuggagugguguuuggugccagccuauuccugcugcuuucauugacaguauucagcauugugagcguaacagccuacauugccuuggcccugcucucugugaccaucagcuuuaggauauacaagggugugauccaagcuauccagaaaucagaugaaggccacccauucagggcauaucuggaaucugaaguugcuauaucugaggaguugguucagaaguacaguaauucugcucuuggucaugugaacugcacgauaaaggaacucaggcgccucuucuuaguugaugauuuaguugauucucugaaguuugcaguguugauguggguauuuaccuauguuggugccuuguuuaauggucugacacuacugauuuuggcucucauuucacucuucaguguuccuguuauuuaugaacggcaucaggcacagauagaucauuaucuaggacuugcaaauaagaauguuaaagaugcuauggcuaaaauccaagcaaaaaucccuggauugaagcgcaaagcugaaugaaaacgcccaaaauaauuaguaggaguucaucuuuaaaggggauauucauuugauuauacgggggagggucagggaagaacgaaccuugacguugcagugcaguuucacagaucguuguuagaucuuuauuuuuagccaugcacuguugugaggaaaaauuaccugucuugacugccauguguucaucaucuuaaguauuguaagcugcuauguauggauuuaaaccguaaucauaucuuuuuccuaucuaucugaggcacugguggaauaaaaaaccuguauauuuuacuuuguugcagauagucuugccgcaucuuggcaaguugcagagaugguggagcuagaaaaaaaaaaaaaaaagcccuuuucaguuugugcacuguguaugguccguguagauugaugcagauuuucugaaaugaaauguuuguuuagacgagaucauaccgguaaagcaggaaugacaaagcuugcuuuucugguauguucuagguguauugugacuuuuacuguuauauuaauugccaauauaaguaaauauagauuauauauguauaguguuucacaaagcuuagaccuuuaccuuccagccaccccacagugcuugauauuucagagucagucauugguuauacauguguaguuccaaagcacauaagcuagaagaagaaauauuucuaggagcacuaccaucuguuuucaacaugaaaugccacacacauagaacuccaacaucaauuucauugcacagacugacuguaguuaauuuugucacagaaucuauggacugaaucuaaugcuuccaaaaauguuguuuguuugcaaauaucaaacauuguuaugcaagaaauuauuaauuacaaaaugaagauuuauaccauugugguuuaagcuguacugaacuaaaucuguggaaugcauugugaacuguaaaagcaaaguaucaauaaagcuuauagacuuaaaaaaaaaaaaaaaaaaaaaaaaaaaaaaa

SEQ ID NO: 171 - RNA, 1808 nt, Homo_Sapiens
agccuaguuacagauugcacugcgucagacuguuccacacccagaagacgucaggugacuucaguccugcugcaguugugcagcagaggagacugcagacuucgguugaggaaacggguauuucaugucucagggaguagguuugugcaguuacagcuuuucuguugguaugcauaauuaauaauuggagcugcaaagcagaucgugacaagagauggacggucagaagaaaaauuggaaggacaagguuguugaccuccuguacuggagagacauuaagaagacuggagugguguuuggugccagccuauuccugcugcuuucauugacaguauucagcauugugagcguaacagccuacauugccuuggcccugcucucugugaccaucagcuuuaggauauacaagggugugauccaagcuauccagaaaucagaugaaggccacccauucagggcauaucuggaaucugaaguugcuauaucugaggaguugguucagaaguacaguaauucugcucuuggucaugugaacugcacgauaaaggaacucaggcgccucuucuuaguugaugauuuaguugauucucugaaguuugcaguguugauguggguauuuaccuauguuggugccuuguuuaauggucugacacuacugauuuuggcucucauuucacucuucaguguuccuguuauuuaugaacggcaucaggcacagauagaucauuaucuaggacuugcaaauaagaauguuaaagaugcuauggcuaaaauccaagcaaaaaucccuggauugaagcgcaaagcugaaugaaaacgcccaaaauaauuaguaggaguucaucuuuaaaggggauauucauuugauuauacgggggagggucagggaagaacgaaccuugacguugcagugcaguuucacagaucguuguuagaucuuuauuuuuagccaugcacuguugugaggaaaaauuaccugucuugacugccauguguucaucaucuuaaguauuguaagcugcuauguauggauuuaaaccguaaucauaucuuuuuccuaucuaucugaggcacugguggaauaaaaaaccuguauauuuuacuuuguugcagauagucuugccgcaucuuggcaaguugcagagaugguggagcuagaaaaaaaaaaaaaaaagcccuuuucaguuugugcacuguguaugguccguguagauugaugcagauuuucugaaaugaaauguuuguuuagacgagaucauaccgguaaagcaggaaugacaaagcuugcuuuucugguauguucuagguguauugugacuuuuacuguuauauuaauugccaauauaaguaaauauagauuauauauguauaguguuucacaaagcuuagaccuuuaccuuccagccaccccacagugcuugauauuucagagucagucauugguuauacauguguaguuccaaagcacauaagcuagaagaagaaauauuucuaggagcacuaccaucuguuuucaacaugaaaugccacacacauagaacuccaacaucaauuucauugcacagacugacuguaguuaauuuugucacagaaucuauggacugaaucuaaugcuuccaaaaauguuguuuguuugcaaauaucaaacauuguuaugcaagaaauuauuaauuacaaaaugaagauuuauaccauugugguuuaagcuguacugaacuaaaucuguggaaugcauugugaacuguaaaagcaaaguaucaauaaagcuuauagacuuaaaaaaaaaaaaaaaaaaaaaaaaaaaaaaa

SEQ ID NO: 172 - RNA, 2471 nt, Homo_Sapiens
agucccugcccuccccuggggagggugagucacgccaaacugggcggagaguccgcuggccucacuccuagcucaucugggcggcggcggcaaguggggacagggcggguggcgcaucaccggcgcggaggcaggaggagcagucucauuguuccgggagccgucaccacaguaggucccucggcucagucggcccagccccucucaguccuccccaacccccacaaccgcccgcggcucugagacgcggccccggcggcggcggcagcagcugcagcaucaucuccacccuccagccauggaagaccuggaccagucuccucuggucucguccucggacagcccaccccggccgcagcccgcguucaaguaccaguucgugagggagcccgaggacgaggaggaagaagaggaggaggaagaggaggacgaggacgaagaccuggaggagcuggaggugcuggagaggaagcccgccgccgggcuguccgcggccccagugcccaccgccccugccgccggcgcgccccugauggacuucggaaaugacuucgugccgccggcgccccggggaccccugccggccgcuccccccgucgccccggagcggcagccgucuugggacccgagcccggugucgucgaccgugcccgcgccauccccgcugucugcugccgcagucucgcccuccaagcucccugaggacgacgagccuccggcccggccucccccuccucccccggccagcgugagcccccaggcagagcccguguggaccccgccagccccggcucccgccgcgccccccuccaccccggccgcgcccaagcgcaggggcuccucgggcucaguggaugagacccuuuuugcucuuccugcugcaucugagccugugauacgcuccucugcaguuguugaccuccuguacuggagagacauuaagaagacuggagugguguuuggugccagccuauuccugcugcuuucauugacaguauucagcauugugagcguaacagccuacauugccuuggcccugcucucugugaccaucagcuuuaggauauacaagggugugauccaagcuauccagaaaucagaugaaggccacccauucagggcauaucuggaaucugaaguugcuauaucugaggaguugguucagaaguacaguaauucugcucuuggucaugugaacugcacgauaaaggaacucaggcgccucuucuuaguugaugauuuaguugauucucugaaguuugcaguguugauguggguauuuaccuauguuggugccuuguuuaauggucugacacuacugauuuuggcucucauuucacucuucaguguuccuguuauuuaugaacggcaucaggcacagauagaucauuaucuaggacuugcaaauaagaauguuaaagaugcuauggcuaaaauccaagcaaaaaucccuggauugaagcgcaaagcugaaugaaaacgcccaaaauaauuaguaggaguucaucuuuaaaggggauauucauuugauuauacgggggagggucagggaagaacgaaccuugacguugcagugcaguuucacagaucguuguuagaucuuuauuuuuagccaugcacuguugugaggaaaaauuaccugucuugacugccauguguucaucaucuuaaguauuguaagcugcuauguauggauuuaaaccguaaucauaucuuuuuccuaucuaucugaggcacugguggaauaaaaaaccuguauauuuuacuuuguugcagauagucuugccgcaucuuggcaaguugcagagaugguggagcuagaaaaaaaaaaaaaaaagcccuuuucaguuugugcacuguguaugguccguguagauugaugcagauuuucugaaaugaaauguuuguuuagacgagaucauaccgguaaagcaggaaugacaaagcuugcuuuucugguauguucuagguguauugugacuuuuacuguuauauuaauugccaauauaaguaaauauagauuauauauguauaguguuucacaaagcuuagaccuuuaccuuccagccaccccacagugcuugauauuucagagucagucauugguuauacauguguaguuccaaagcacauaagcuagaagaagaaauauuucuaggagcacuaccaucuguuuucaacaugaaaugccacacacauagaacuccaacaucaauuucauugcacagacugacuguaguuaauuuugucacagaaucuauggacugaaucuaaugcuuccaaaaauguuguuuguuugcaaauaucaaacauuguuaugcaagaaauuauuaauuacaaaaugaagauuuauaccauugugguuuaagcuguacugaacuaaaucuguggaaugcauugugaacuguaaaagcaaaguaucaauaaagcuuauagacuuaaaaaaaaaaaaaaaaaaaaaaaaaaaaaaa

SEQ ID NO: 173 - RNA, 4129 nt, Homo_Sapiens
gugcucguggggagcuggccgaguggaaaacguccacauugacccaaccgcagugaagggagagcgccuccagugguguggugcguggagaaaugggaaggagagaguucugaugagacccuuuuugcucuuccugcugcaucugagccugugauacgcuccucugcagaaaauauggacuugaaggagcagccagguaacacuauuucggcuggucaagaggauuucccaucuguccugcuugaaacugcugcuucucuuccuucucugucuccucucucagccgcuucuuucaaagaacaugaauaccuugguaauuugucaacaguauuacccacugaaggaacacuucaagaaaaugucagugaagcuucuaaagaggucucagagaaggcaaaaacucuacucauagauagagauuuaacagaguuuucagaauuagaauacucagaaaugggaucaucguucagugucucuccaaaagcagaaucugccguaauaguagcaaauccuagggaagaaauaaucgugaaaaauaaagaugaagaagagaaguuaguuaguaauaacauccuucauaaucaacaagaguuaccuacagcucuuacuaaauugguuaaagaggaugaaguugugucuucagaaaaagcaaaagacaguuuuaaugaaaagagaguugcaguggaagcuccuaugagggaggaauaugcagacuucaaaccauuugagcgaguaugggaagugaaagauaguaaggaagauagugauauguuggcugcuggagguaaaaucgagagcaacuuggaaaguaaaguggauaaaaaauguuuugcagauagccuugagcaaacuaaucacgaaaaagauagugagaguaguaaugaugauacuucuuuccccaguacgccagaagguauaaaggaucguucaggagcauauaucacaugugcucccuuuaacccagcagcaacugagagcauugcaacaaacauuuuuccuuuguuaggagauccuacuucagaaaauaagaccgaugaaaaaaaaauagaagaaaagaaggcccaaauaguaacagagaagaauacuagcaccaaaacaucaaacccuuuucuuguagcagcacaggauucugagacagauuaugucacaacagauaauuuaacaaaggugacugaggaagucguggcaaacaugccugaaggccugacuccagauuuaguacaggaagcaugugaaagugaauugaaugaaguuacugguacaaagauugcuuaugaaacaaaaauggacuugguucaaacaucagaaguuaugcaagagucacucuauccugcagcacagcuuugcccaucauuugaagagucagaagcuacuccuucaccaguuuugccugacauuguuauggaagcaccauugaauucugcaguuccuagugcuggugcuuccgugauacagcccagcucaucaccauuagaagcuucuucaguuaauuaugaaagcauaaaacaugagccugaaaaccccccaccauaugaagaggccaugaguguaucacuaaaaaaaguaucaggaauaaaggaagaaauuaaagagccugaaaauauuaaugcagcucuucaagaaacagaagcuccuuauauaucuauugcaugugauuuaauuaaagaaacaaagcuuucugcugaaccagcuccggauuucucugauuauucagaaauggcaaaaguugaacagccagugccugaucauucugagcuaguugaagauuccucaccugauucugaaccaguugacuuauuuagugaugauucaauaccugacguuccacaaaaacaagaugaaacugugaugcuugugaaagaaagucucacugagacuucauuugagucaaugauagaauaugaaaauaaggaaaaacucagugcuuugccaccugagggaggaaagccauauuuggaaucuuuuaagcucaguuuagauaacacaaaagauacccuguuaccugaugaaguuucaacauugagcaaaaaggagaaaauuccuuugcagauggaggagcucaguacugcaguuuauucaaaugaugacuuauuuauuucuaaggaagcacagauaagagaaacugaaacguuuucagauucaucuccaauugaaauuauagaugaguucccuacauugaucaguucuaaaacugauucauuuucuaaauuagccagggaauauacugaccuagaaguaucccacaaaagugaaauugcuaaugccccggauggagcugggucauugccuugcacagaauugccccaugaccuuucuuugaagaacauacaacccaaaguugaagagaaaaucaguuucucagaugacuuuucuaaaaaugggucugcuacaucaaaggugcucuuauugccuccagauguuucugcuuuggccacucaagcagagauagagagcauaguuaaacccaaaguucuugugaaagaagcugagaaaaaacuuccuuccgauacagaaaaagaggacagaucaccaucugcuauauuuucagcagagcugaguaaaacuucaguuguugaccuccuguacuggagagacauuaagaagacuggagugguguuuggugccagccuauuccugcugcuuucauugacaguauucagcauugugagcguaacagccuacauugccuuggcccugcucucugugaccaucagcuuuaggauauacaagggugugauccaagcuauccagaaaucagaugaaggccacccauucagggcauaucuggaaucugaaguugcuauaucugaggaguugguucagaaguacaguaauucugcucuuggucaugugaacugcacgauaaaggaacucaggcgccucuucuuaguugaugauuuaguugauucucugaaguuugcaguguugauguggguauuuaccuauguuggugccuuguuuaauggucugacacuacugauuuuggcucucauuucacucuucaguguuccuguuauuuaugaacggcaucaggcacagauagaucauuaucuaggacuugcaaauaagaauguuaaagaugcuauggcuaaaauccaagcaaaaaucccuggauugaagcgcaaagcugaaugaaaacgcccaaaauaauuaguaggaguucaucuuuaaaggggauauucauuugauuauacgggggagggucagggaagaacgaaccuugacguugcagugcaguuucacagaucguuguuagaucuuuauuuuuagccaugcacuguugugaggaaaaauuaccugucuugacugccauguguucaucaucuuaaguauuguaagcugcuauguauggauuuaaaccguaaucauaucuuuuuccuaucuaucugaggcacugguggaauaaaaaaccuguauauuuuacuuuguugcagauagucuugccgcaucuuggcaaguugcagagaugguggagcuagaaaaaaaaaaaaaaaagcccuuuucaguuugugcacuguguaugguccguguagauugaugcagauuuucugaaaugaaauguuuguuuagacgagaucauaccgguaaagcaggaaugacaaagcuugcuuuucugguauguucuagguguauugugacuuuuacuguuauauuaauugccaauauaaguaaauauagauuauauauguauaguguuucacaaagcuuagaccuuuaccuuccagccaccccacagugcuugauauuucagagucagucauugguuauacauguguaguuccaaagcacauaagcuagaagaagaaauauuucuaggagcacuaccaucuguuuucaacaugaaaugccacacacauagaacuccaacaucaauuucauugcacagacugacuguaguuaauuuugucacagaaucuauggacugaaucuaaugcuuccaaaaauguuguuuguuugcaaauaucaaacauuguuaugcaagaaauuauuaauuacaaaaugaagauuuauaccauugugguuuaagcuguacugaacuaaaucuguggaaugcauugugaacuguaaaagcaaaguaucaauaaagcuuauagacuuaaaaaaaaaaaaaaaaaaaaaaaaaaaaaaa

SEQ ID NO: 174 - RNA, 1924 nt, Homo_Sapiens
cugugcgcccugcgcgcccugcgcacccgcggcccgagcccagccagagccgggcggagcggagcgcgccgagccucgucccgcggccgggccggggccgggccguagcggcggcgccuggaugcggacccggccgcggggagacgggcgcccgccccgaaacgacuuucaguccccgacgcgccccgcccaaccccuacgaugaagagggcguccgcuggagggagccggcugcuggcaugggugcuguggcugcaggccuggcagguggcagccccaugcccaggugccugcguaugcuacaaugagcccaaggugacgacaagcugcccccagcagggccugcaggcugugcccgugggcaucccugcugccagccagcgcaucuuccugcacggcaaccgcaucucgcaugugccagcugccagcuuccgugccugccgcaaccucaccauccuguggcugcacucgaaugugcuggcccgaauugaugcggcugccuucacuggccuggcccuccuggagcagcuggaccucagcgauaaugcacagcuccggucuguggacccugccacauuccacggccugggccgccuacacacgcugcaccuggaccgcugcggccugcaggagcugggcccggggcuguuccgcggccuggcugcccugcaguaccucuaccugcaggacaacgcgcugcaggcacugccugaugacaccuuccgcgaccugggcaaccucacacaccucuuccugcacggcaaccgcaucuccagcgugcccgagcgcgccuuccgugggcugcacagccucgaccgucuccuacugcaccagaaccgcguggcccaugugcacccgcaugccuuccgugaccuuggccgccucaugacacucuaucuguuugccaacaaucuaucagcgcugcccacugaggcccuggccccccugcgugcccugcaguaccugaggcucaacgacaaccccugggugugugacugccgggcacgcccacucugggccuggcugcagaaguuccgcggcuccuccuccgaggugcccugcagccucccgcaacgccuggcuggccgugaccucaaacgccuagcugccaaugaccugcagggcugcgcuguggccaccggcccuuaccaucccaucuggaccggcagggccaccgaugaggagccgcuggggcuucccaagugcugccagccagaugccgcugacaaggccucaguacuggagccuggaagaccagcuucggcaggcaaugcgcugaagggacgcgugccgcccggugacagcccgccgggcaacggcucuggcccacggcacaucaaugacucacccuuugggacucugccuggcucugcugagcccccgcucacugcagugcggcccgagggcuccgagccaccaggguuccccaccucgggcccucgccggaggccaggcuguucacgcaagaaccgcacccgcagccacugccgucugggccaggcaggcagcggggguggcgggacuggugacucagaaggcucaggugcccuacccagccucaccugcagccucaccccccugggccuggcgcuggugcuguggacagugcuugggcccugcugacccccagcggacacaagagcgugcucagcagccagguguguguacauacggggucucucuccacgccgccaagccagccgggcggccgacccguggggcaggccaggccagguccucccugauggacgccugccgcccgccacccccaucuccaccccaucauguuuacaggguucggcggcagcguuuguuccagaacgccgccucccacccagaucgcgguauauagagauaugcauuuuauuuuacuuguguaaaaauaucggacgacguggaauaaagagcucuuuucuuaaaaaaa

SEQ ID NO: 175 - RNA, 2380 nt, Homo_Sapiens
cuagacccuggaaggcaggggacugcgagcugggcuggcggagcagaggugcagaagcaacugaguccaaguugucuggcggcuucagguggacccagaagacguccccaacucagggagauucagcgaucacucacucgcuguacagaaugauauuccucacggcacugccucuguucuggauuaugauuucagccucccgagggggucacuggggugccuggaugcccucguccaucucggccuucgaaggcacgugcgucuccauccccugccgcuuugacuucccggaugagcugcggcccgcuguggugcauggugucugguacuucaauagccccuaccccaagaacuaccccccgguggucuucaagucgcgcacccaaguaguccacgagagcuuccagggccgcagccgccuccugggggaccugggccugcgaaacugcacccuccugcucagcaacgucagccccgagcugggcgggaaguacuacuuccguggggaccugggcggcuacaaccaguacaccuucucagagcacagcguccuggauaucgucaacacccccaacaucguggugcccccagaggugguggcaggcacggagguggaggucagcugcauggugccggacaacugcccagagcugcgcccugagcugagcuggcugggccacgaggggcugggggagcccgcugugcugggccggcugcgggaggacgagggcaccugggugcaggugucacugcugcacuucgugcccacgagggaggccaacggccacaggcugggcugccaggccuccuuccccaacaccacccugcaguucgagggcuacgccagcauggacgucaaguaccccccggugauuguggagaugaacuccucgguggaggccaucgagggcucccacgugagccugcucuguggggcugacagcaaccccccgccgcugcugaccuggaugcgggacgggacaguccuccgggaggcgguggccgagagccugcuccuggagcuggaggaggugacccccgccgaagacggcgucuaugccugccuggccgagaaugccuauggccaggacaaccgcaccguggggcucagugucauguaugcacccuggaagccaacagugaacgggacaaugguggccguagagggggagacggucucuaucuugugcuccacacagagcaacccggacccuauucucaccaucuucaaggagaagcagauccuguccacggucaucuacgagagcgagcugcagcuggagcugccggccgugucacccgaggaugauggagaguacugguguguggcugagaaccaguauggccagagggccaccgccuucaaccugucuguggaguucgccccugugcuccuccuggagucccacugcgcggcagcccgagacacggugcagugccugugcguggugaaguccaacccggagccguccguggccuuugagcugccaucgcgcaaugugaccgugaacgagagcgagcgggaguucguguacucggagcgcagcggccucgugcucaccagcauccucacgcugcgggggcaggcccaggccccgccccgcgucaucugcaccgcgaggaaccucuauggcgccaagagccuggagcugcccuuccagggagcccaucgacugaugugggccaagaucgggccugugggcgccguggucgccuuugccauccugauugccaucgucugcuacauuacccagacacgcaggaaaaagaacgugacagagagccccagcuucucggcaggggacaacccucccguccuguucagcagcgacuuccgcaucucuggggcaccagagaaguacgagagcgagaggcgccugggaucugagaggaggcugcugggccuucggggugagcccccagagcuggaccugagcuauucucacucggaccuggggaaacggcccaccaaggacagcuacacgcugacggaggagcuagcugaguaugcugaaauccgggucaagugaaggagcugggggcagccugcguggcugaccccccucaggacccucgcuggcccccacuggcugugggcucccuuccucccaaaaguaucgggggcuggggcaggaggggagugaggcaggugacagugagguccugggggccugaccucccccuccuucccagcugccccucccugccagcacccccacgcccucauuacggcuccucucuaaccuccuuuacccucaucugucuggaggggagcucugucuguccguguuauuuauugcuacuuccugccuggucuccugcccccacaccuggcccuggggccuguacaaaagggacaugaaauaaaugccccaaagcc

SEQ ID NO: 176 - RNA, 2425 nt, Homo_Sapiens
cuagacccuggaaggcaggggacugcgagcugggcuggcggagcagaggugcagaagcaacugaguccaaguugucuggcggcuucagguggacccagaagacguccccaacucagggagauucagcgaucacucacucgcuguacagaaugauauuccucacggcacugccucuguucuggauuaugauuucagccucccgagggggucacuggggugccuggaugcccucguccaucucggccuucgaaggcacgugcgucuccauccccugccgcuuugacuucccggaugagcugcggcccgcuguggugcauggugucugguacuucaauagccccuaccccaagaacuaccccccgguggucuucaagucgcgcacccaaguaguccacgagagcuuccagggccgcagccgccuccugggggaccugggccugcgaaacugcacccuccugcucagcaacgucagccccgagcugggcgggaaguacuacuuccguggggaccugggcggcuacaaccaguacaccuucucagagcacagcguccuggauaucgucaacacccccaacaucguggugcccccagaggugguggcaggcacggagguggaggucagcugcauggugccggacaacugcccagagcugcgcccugagcugagcuggcugggccacgaggggcugggggagcccgcugugcugggccggcugcgggaggacgagggcaccugggugcaggugucacugcugcacuucgugcccacgagggaggccaacggccacaggcugggcugccaggccuccuuccccaacaccacccugcaguucgagggcuacgccagcauggacgucaaguaccccccggugauuguggagaugaacuccucgguggaggccaucgagggcucccacgugagccugcucuguggggcugacagcaaccccccgccgcugcugaccuggaugcgggacgggacaguccuccgggaggcgguggccgagagccugcuccuggagcuggaggaggugacccccgccgaagacggcgucuaugccugccuggccgagaaugccuauggccaggacaaccgcaccguggggcucagugucauguaugcacccuggaagccaacagugaacgggacaaugguggccguagagggggagacggucucuaucuugugcuccacacagagcaacccggacccuauucucaccaucuucaaggagaagcagauccuguccacggucaucuacgagagcgagcugcagcuggagcugccggccgugucacccgaggaugauggagaguacugguguguggcugagaaccaguauggccagagggccaccgccuucaaccugucuguggaguucgccccugugcuccuccuggagucccacugcgcggcagcccgagacacggugcagugccugugcguggugaaguccaacccggagccguccguggccuuugagcugccaucgcgcaaugugaccgugaacgagagcgagcgggaguucguguacucggagcgcagcggccucgugcucaccagcauccucacgcugcgggggcaggcccaggccccgccccgcgucaucugcaccgcgaggaaccucuauggcgccaagagccuggagcugcccuuccagggagcccaucgacugaugugggccaagaucgggccugugggcgccguggucgccuuugccauccugauugccaucgucugcuacauuacccagacacgcaggaaaaagaacgugacagagagccccagcuucucggcaggggacaacccucccguccuguucagcagcgacuuccgcaucucuggggcaccagagaaguacgaguccaaagagguuucuacccuggaaucucacugagugccccaggagagcgagaggcgccugggaucugagaggaggcugcugggccuucggggugagcccccagagcuggaccugagcuauucucacucggaccuggggaaacggcccaccaaggacagcuacacgcugacggaggagcuagcugaguaugcugaaauccgggucaagugaaggagcugggggcagccugcguggcugaccccccucaggacccucgcuggcccccacuggcugugggcucccuuccucccaaaaguaucgggggcuggggcaggaggggagugaggcaggugacagugagguccugggggccugaccucccccuccuucccagcugccccucccugccagcacccccacgcccucauuacggcuccucucuaaccuccuuuacccucaucugucuggaggggagcucugucuguccguguuauuuauugcuacuuccugccuggucuccugcccccacaccuggcccuggggccuguacaaaagggacaugaaauaaaugccccaaagcc

SEQ ID NO: 177 - RNA, 1945 nt, Homo_Sapiens
auaaauuugagucagcaccagcgacagcucugcaguccuccuaugugguacugaucaggugguugcagagcuucagcucacagcaacacaaugcagcugagcaggcaagcacagcccacagccagaaacaguuccgacucuacagaacaagacgaccuuuaaguuucccagagaaaaugagaugcugauguugaagacgacaccacggcuuugauggaauaucagauauugaaaaugucucucugccuguucauccuucuguuucucacaccugguauuuuaugcauuuguccucuccaauguauaugcacagagaggcacaggcauguggacuguucaggcagaaacuugucuacauuaccaucuggacugcaagagaauauuauacauuuaaaccugucuuauaaccacuuuacugaucugcauaaccaguuaacccaauauaccaaucugaggacccuggacauuucaaacaacaggcuugaaagccugccugcucacuuaccucggucucuguggaacaugucugcugcuaacaacaacauuaaacuucuugacaaaucugauacugcuuaucaguggaaucuuaaauaucuggauguuucuaagaacaugcuggaaaagguuguccucauuaaaaauacacuaagaagucucgagguucucaaccucaguaguaacaaacuuuggacaguuccaaccaacaugcccuccaaacuacauaucguggaccugucuaauaauucuuugacacaaauucuuccagguacauuaauaaaccugacaaaucucacacaucuuuaccugcacaacaauaaguucacauucauuccagaccaaucuuuugaccaacucuuucaguugcaagagauaacccuuuacaauaacagguggucaugugaccacaaacaaaacauuacuuacuuacugaaguggaugauggaaacaaaagcccaugugauagggacuccauguucuacccaaauaucaucuuuaaaggaacauaacauguaucccacaccuucuggauuuaccucaagcuuauucacuguaagugggaugcagacaguggacaccauuaacucucugagugugguaacucaacccaaagugaccaaaauacccaaacaauaucgaacaaaggaaacaacguuuggugccacucuaagcaaagacaccaccuuuacuagcacugauaaggcuuuugugcccuauccagaagauacauccacagagacuaucaauucacaugaagcagcagcugcaacucuaacuauucaucuccaagauggaauggucacaaacacaagccucacuagcucaacaaaaucauccccaacacccaugacccuaaguaucacuaguggcaugccaaauaauuucucugaaaugccucaacaaagcacaacccuuaacuuauggagggaagagacaaccacaaauguaaagacuccauuaccuucuguggcaaaugcuuggaaaguaaaugcuucauuucucuuauugcucaauguuguggucaugcuggcugucugagggucugcauuuucugaaacuaaugaaagcacuccucccugauguacaguugggaaaauauguccauaucuaaccagugauucgagcuauauuuaaguauucaagaaagccagucuuaacauuucuaacucugauguaaaugaaguaacuugucuuaaauaaaagaaaugcacaaugucuugguacuugcugcuauuuuacugucuuaauuaaguaaacuaaugaguuucuuuuauaaaaaaaaugaaauguuuuaaggcuucaauuuauugcacaaaauauaaagcaucuaaacuuuaauauguauuuuauguauguuuacacugucaaacaucuggaaaauaaaaggucuaugcucaaaaaaaaaaaaaaaaaaaaaaaaaaaaaaaaaaaaaaaaaaaaaaaaaaa

SEQ ID NO: 178 - RNA, 3488 nt, Homo_Sapiens
ccuugcucucgccgcugcugccggagccgaagcagagaaggcagcgggucccgugaccgucccgagagccccgcgcucccgaccagggggcgggggcggccccggggagggcggggcaggggcggggggaagaaaggggguuuugugcugcgccgggagggccggcgcccucuuccgaauguccugcggccccagccucuccucacgcucgcgcagucuccgccgcagucucagcugcagcugcaggacugagccgugcacccggaggagacccccggaggaggcgacaaacuucgcagugccgcgacccaaccccagcccuggguagccugcagcauggcccagcuguuccugccccugcuggcagcccugguccuggcccaggcuccugcagcuuuagcagauguucuggaaggagacagcucagaggaccgcgcuuuucgcgugcgcaucgcgggcgacgcgccacugcagggcgugcucggcggcgcccucaccaucccuugccacguccacuaccugcggccaccgccgagccgccgggcugugcugggcucuccgcgggucaaguggacuuuccugucccggggccgggaggcagaggugcugguggcgcggggagugcgcgucaaggugaacgaggccuaccgguuccgcguggcacugccugcguacccagcgucgcucaccgacgucucccuggcgcugagcgagcugcgccccaacgacucagguaucuaucgcugugagguccagcacggcaucgaugacagcagcgacgcuguggaggucaaggucaaaggggucgucuuucucuaccgagagggcucugcccgcuaugcuuucuccuuuucuggggcccaggaggccugugcccgcauuggagcccacaucgccaccccggagcagcucuaugccgccuaccuugggggcuaugagcaaugugaugcuggcuggcugucggaucagaccgugagguaucccauccagaccccacgagaggccuguuacggagacauggauggcuuccccgggguccggaacuauggugugguggacccggaugaccucuaugauguguacuguuaugcugaagaccuaaauggagaacuguuccugggugacccuccagagaagcugacauuggaggaagcacgggcguacugccaggagcggggugcagagauugccaccacgggccaacuguaugcagccugggaugguggccuggaccacugcagcccaggguggcuagcugauggcagugugcgcuaccccaucgucacacccagccagcgcuguggugggggcuugccuggugucaagacucucuuccucuuccccaaccagacuggcuuccccaauaagcacagccgcuucaacgucuacugcuuccgagacucggcccagccuucugccaucccugaggccuccaacccagccuccaacccagccucugauggacuagaggcuaucgucacagugacagagacccuggaggaacugcagcugccucaggaagccacagagagugaaucccguggggccaucuacuccauccccaucauggaggacggaggagguggaagcuccacuccagaagacccagcagaggccccuaggacgcuccuagaauuugaaacacaauccaugguaccgcccacgggguucucagaagaggaagguaaggcauuggaggaagaagagaaauaugaagaugaagaagagaaagaggaggaagaagaagaggaggagguggaggaugaggcucugugggcauggcccagcgagcucagcagcccgggcccugaggccucucuccccacugagccagcagcccaggaggagucacucucccaggcgccagcaagggcaguccugcagccuggugcaucaccacuuccugauggagagucagaagcuuccaggccuccaaggguccauggaccaccuacugagacucugcccacucccagggagaggaaccuagcauccccaucaccuuccacucugguugaggcaagagaggugggggaggcaacuggugguccugagcuaucuggggucccucgaggagagagcgaggagacaggaagcuccgagggugccccuucccugcuuccagccacacgggccccugaggguaccagggagcuggaggcccccucugaagauaauucuggaagaacugccccagcagggaccucagugcaggcccagccagugcugcccacugacagcgccagccgagguggaguggccgugguccccgcaucaggugacuguguccccagccccugccacaauggugggacaugcuuggaggaggaggaagggguccgcugccuaugucugccuggcuaugggggggaccugugcgauguuggccuccgcuucugcaaccccggcugggacgccuuccagggcgccugcuacaagcacuuuuccacacgaaggagcugggaggaggcagagacccagugccggauguacggcgcgcaucuggccagcaucagcacacccgaggaacaggacuucaucaacaaccgguaccgggaguaccaguggaucggacucaacgacaggaccaucgaaggcgacuucuuguggucggauggcgucccccugcucuaugagaacuggaacccugggcagccugacagcuacuuccugucuggagagaacugcguggucaugguguggcaugaucagggacaauggagugacgugcccugcaacuaccaccuguccuacaccugcaagauggggcugguguccugugggccgccaccggagcugccccuggcucaaguguucggccgcccacggcugcgcuaugagguggacacugugcuucgcuaccggugccgggaaggacuggcccagcgcaaucugccgcugauccgaugccaagagaacggucguugggaggccccccagaucuccugugugcccagaagaccugcccgagcucugcacccagaggaggacccagaaggacgucaggggaggcuacugggacgcuggaaggcgcuguugauccccccuuccagccccaugccaggucccuagggggcaaggccuugaacacugccggccacagcacugcccugucacccaaauuuucccucacacccugcgcucccgccaccacaggaagugacaacaugacgaggggugguacuggaguccaggugacaguuccugaaggggcuucugggaaauaccuaggaggcuccagcccagcccaggcccucucccccuacccugggcaccagaucuuccaucagggccggaguaaaucccuaagugccucaacugcccucucccuggcagccaucuuguccccucuauuccucuagggagcacugugcccacucuuucuggguuuuccaagggaaugggcuugcaggauggagugucuguaaaaucaacaggaaauaaaacuguguaugagcccaggcaaaaaaaaaaaaaaaaaaaaaaaa

SEQ ID NO: 179 - RNA, 2872 nt, Homo_Sapiens
ccuugcucucgccgcugcugccggagccgaagcagagaaggcagcgggucccgugaccgucccgagagccccgcgcucccgaccagggggcgggggcggccccggggagggcggggcaggggcggggggaagaaaggggguuuugugcugcgccgggagggccggcgcccucuuccgaauguccugcggccccagccucuccucacgcucgcgcagucuccgccgcagucucagcugcagcugcaggacugagccgugcacccggaggagacccccggaggaggcgacaaacuucgcagugccgcgacccaaccccagcccuggguagccugcagcauggcccagcuguuccugccccugcuggcagcccugguccuggcccaggcuccugcagcuuuagcaauguucuggaaggagacagcucagaggaccgcgcuuuucgcgugcgcaucgcgggcgacgcgccacugcagggcgugcucggcggcgcccucaccaucccuugccacguccacuaccugcggccaccgccgagccgccgggcugugcugggcucuccgcgggucaaguggacuuuccugucccggggccgggaggcagaggugcugguggcgcggggagugcgcgucaaggugaacgaggccuaccgguuccgcguggcacugccugcguacccagcgucgcucaccgacgucucccuggcgcugagcgagcugcgccccaacgacucagguaucuaucgcugugagguccagcacggcaucgaugacagcagcgacgcuguggaggucaaggucaaaggggucgucuuucucuaccgagagggcucugcccgcuaugcuuucuccuuuucuggggcccaggaggccugugcccgcauuggagcccacaucgccaccccggagcagcucuaugccgccuaccuugggggcuaugagcaaugugaugcuggcuggcugucggaucagaccgugagguaucccauccagaccccacgagaggccuguuacggagacauggauggcuuccccgggguccggaacuauggugugguggacccggaugaccucuaugauguguacuguuaugcugaagaccuaaauggagaacuguuccugggugacccuccagagaagcugacauuggaggaagcacgggcguacugccaggagcggggugcagagauugccaccacgggccaacuguaugcagccugggaugguggccuggaccacugcagcccaggguggcuagcugauggcagugugcgcuaccccaucgucacacccagccagcgcuguggugggggcuugccuggugucaagacucucuuccucuuccccaaccagacuggcuuccccaauaagcacagccgcuucaacgucuacugcuuccgagacucggcccagccuucugccaucccugaggccuccaacccagccuccaacccagccucugauggacuagaggcuaucgucacagugacagagacccuggaggaacugcagcugccucaggaagccacagagagugaaucccguggggccaucuacuccauccccaucauggaggacggaggagguggaagcuccacuccagaagacccagcagaggccccuaggacgcuccuagaauuugaaacacaauccaugguaccgcccacgggguucucagaagaggaagguaaggcauuggaggaagaagagaaauaugaagaugaagaagagaaagaggaggaagaagaagaggaggagguggaggaugaggcucugugggcauggcccagcgagcucagcagcccgggcccugaggccucucuccccacugagccagcagcccaggaggagucacucucccaggcgccagcaagggcaguccugcagccuggugcaucaccacuuccugauggagagucagaagcuuccaggccuccaaggguccauggaccaccuacugagacucugcccacucccagggagaggaaccuagcauccccaucaccuuccacucugguugaggcaagagaggugggggaggcaacuggugguccugagcuaucuggggucccucgaggagagagcgaggagacaggaagcuccgagggugccccuucccugcuuccagccacacgggccccugaggguaccagggagcuggaggcccccucugaagauaauucuggaagaacugccccagcagggaccucagugcaggcccagccagugcugcccacugacagcgccagccgagguggaguggccgugguccccgcaucagguaauucugcccaaggcucaacugcccucucuauccuacuccuuuucuucccccugcagcucugggucaccugaccuguaguccuuuaacccaccaucaucccaaacucuccuguccuuugccuucauucucuuacccaccucuaccuaugggucuccaaucucggauauccaccuuguggguaucucagcucuccgcgucuuuacccugugaucccagccccgccacugaccaucugugacccuucccugccauugggcccuccaccuguggcucacaucucgccagccccacagagcauccucaggccucuccaaggguccucaucaccuauugcagccuucagggcucggccuauuuuccacuacucccuucauccgccugugugccguccccuuuagcugccuccuauugaucucagggaagccugggagucccuucucaccccucaaccuccggaguccaggagaacccguacccccacagagccuuaagcaacuacuucugugaaguauuuuuugacuguuucauggaaaacaagccuuggaaauaaaucucuauuaaaccgcuuuguaaccaaaaaaaaaaaaaaaaa

SEQ ID NO: 180 - RNA, 6406 nt, Homo_Sapiens
ggggcuggacccggcgcggagcuggcugagucggagcgcagcguccuuugugcccggcggccgccccgggaugcguccgagcuaggagccagauccaggaugggggccccguuugucugggccuugggccuuuugaugcugcagaugcugcucuuuguggcuggggaacagggcacacaggauaucaccgaugccagcgaaagggggcuccacaugcagaagcuggggucugggucagugcaggcugcgcuggcggagcugguggcccugcccugucucuuuacccugcagccacggccaagcgcagcccgagaugccccucggauaaaguggaccaaggugcggacugcgucgggccagcgacaggacuugcccauccugguggccaaggacaaugucgugaggguggccaaaagcuggcagggacgagugucacugccuuccuacccccggcgccgagccaacgccacgcuacuucuggggccacugagggccagugacucugggcuguaccgcugccagguggugaggggcaucgaggaugagcaggaccuggugcccuuggaggugacagguguuguguuccacuaccgaucagcccgggaccgcuaugcacugaccuucgcugaggcccaggaggccugccgucucagcucagccaucauugcagccccucggcaucuacaggcugccuuugaggauggcuuugacaacugugaugcuggcuggcucucugaccgcacuguucgguauccuaucacccagucccguccugguugcuauggcgaccguagcagccuuccagggguucggagcuaugggaggcgcaacccacaggaacucuacgauguguauugcuuugcccgggagcuggggggcgaggucuucuacgugggcccggcccgccgccugacacuggccggcgcgcgugcacagugccgccgccagggugccgcgcuggccucggugggacagcugcaccuggccuggcaugagggccuggaccagugcgacccgggcuggcuggccgacggcagcgugcgcuacccgauccagacgccgcgccggcgcugcgggggcccagccccgggcgugcgcaccgucuaccgcuucgcuaaccggaccggcuuccccucacccgccgagcgcuucgacgccuacugcuuccgagcucaucaccccacgucacaacauggagaccuagagaccccauccucuggggaugagggggagauucugucagcagaggggcccccaguuagagaacuggagcccacccuggaggaggaagagguggucaccccugacuuccaggagccucugguguccaguggggaagaagaaacccugauuuuggaggagaagcaggagucucaacagacccucagcccuaccccuggggaccccaugcuggccucauggcccacuggggaaguguggcuaagcacgguggcccccagcccuagcgacaugggggcaggcacugcagcaaguucacacacggagguggccccaacugacccuaugccuaggagaagggggcgcuucaaaggguugaaugggcgcuacuuccagcagcaggaaccggagccggggcugcaaggggggauggaggccagcgcccagccccccaccucagaggcugcagugaaccaaauggagccuccguuggccauggcagucacagagauguugggcaguggccagagccggagccccugggcugaucugaccaaugagguggauaugccuggagcugguucugcugguggcaagagcuccccagagcccuggcuguggcccccuaccauggucccacccagcaucucaggccacagcagggccccuguccuggagcuagagaaagccgagggccccagugccaggccagccaccccagaccuguuuuggucccccuuggaggccacugucucagcucccagcccugcccccugggaggcauucccuguggccaccuccccagaucucccuaugauggccaugcugcguggucccaaagaguggaugcuaccacaccccacccccaucuccaccgaggccaauagaguugaggcacauggugaggccaccgccacggcuccacccuccccugcugcagagaccaagguguauucccugccucucucuuugaccccaacaggacaggguggagaggccaugcccacaacaccugagucccccagggcagacuucagagaaacuggggagaccagcccugcucaggucaacaaagcugagcacuccagcuccagcccauggccuucuguaaacaggaauguggcuguagguuuuguccccacugagacugccacugagccaacgggccucagggguaucccggggucugagucuggggucuucgacacagcagaaagccccacuucuggcuugcaggccacuguagaugaggugcaggaccccuggcccucaguguacagcaaagggcuggaugcaaguuccccaucugccccccuggggagcccuggagucuucuugguacccaaagucaccccaaauuuggagccuuggguugcuacagaugaaggacccacugugaaucccauggauuccacagucacgccggcccccagugaugcuaguggaauuugggaaccuggaucccagguguuugaagaagccgaaagcaccaccuugagcccucagguggcccuggauacaagcauugugacgccccucacgacccuggagcagggggacaagguuggaguuccagccaugucuacacugggcuccucaagcucccaaccccacccagagccagaggaucagguggagacccagggaacaucaggagcuucagugccuccgcaucagagcaguccccuagggaaaccggcuguuccuccugggacaccgacugcagccagugugggcgagucugccucaguuuccucaggggagccuacgguaccgugggaccccuccagcacccugcugccugucacccugggcauagaggacuucgaacuggagguccuggcagggagcccggguguagagagcuucugggaggagguggcaaguggagaggagccagcccugccagggaccccuaugaaugcaggugcggaggaggugcacucagaucccugugagaacaacccuugucuucauggagggacauguaaugccaauggcaccauguauggcuguagcugugaucagggcuucgccggggagaacugugagauugacauugaugacugccucugcagccccugugagaauggaggcaccuguauugaugaggucaauggcuuugucugccuuugccuccccagcuaugggggcagcuuuugugagaaagacaccgagggcugugaccgcggcuggcauaaguuccagggccacuguuaccgcuauuuugcccaccggagggcaugggaagaugccgagaaggacugccgccgccgcuccggccaccugaccagcguccacucaccggaggaacacagcuucauuaauagcuuugggcaugaaaacacguggaucggccugaacgacaggaucguggagagagauuuccaguggacggacaacaccgggcugcaauuugagaacuggcgagagaaccagccggacaauuucuucgcggguggcgaggacuguguggugaugguggcgcaugaaagcgggcgcuggaacgauguccccugcaacuacaaccuacccuaugucugcaagaagggcacagugcucuguggucccccuccggcaguggagaaugccucacucaucggugcccgcaaggccaaguacaauguccaugccacuguaagguaccagugcaaugaaggauuugcccagcaccauguggccaccauucgaugccggagcaauggcaagugggacaggccccaaauugucugcaccaaacccagacguucacaucggaugcggcgacaccaccaccaccaccaacaccaccaccagcaucaccaccacaaaucccgcaaggagcgcagaaaacacaagaaacacccaacggaggacugggagaaggacgaagggaauuucugcugaagaaccagaaaaaagaaagcacaacaccuuucccaugccuccucuggagccuucgccuggggagacagaacccagagagaaacaagagaguccagaagucccugaaccccaaaccacaucccccacacacauaauccuuuguacaaagcuccucuuuucccuuuuuuuacauacacaagauccucuuggcagguggagccaggugucugaaaaguucauucucgucuggcugaacucugggagugugucccagcugagggaagcacaaguagcaaagcucauuggucuggucucuuguuugccaggcugauugaagcaggccuugaugagggugcaugaguguauguuugcauucacaugaaggaauugcuuuucacaccagaaauucagacuuagucaauguuggcugaauuccuaaauccaggaagaagccuggacguagggucauuagcuuugggaauagaaggcuacacagaagcacacuguuuuugaacuugacaacagcucucccuuuacccuggacuucagcccaaguuccgucuuuggucuugguggauaaacacacaguguggagaucccacguacugcauuuuagggauguuuuuaggacaaccucccuccaugccuucagaguuaggagugagaaugaucaaagcaauauguaggugauggagggagaguguauugcuaacccuuccaggucuaguccagcgcugagauuuggugguucugcaugugugaugaaucucuuucacacaaauagacgagaggauauuuagggcuagaugagcccagauuucuucccccuccaucucucagggagacaaagaaccuccuuccuggaccaaggaggugcugccaaguuuucuagcccagugcacauacccaguccuuaagcagacauugguagugccccugcccugggucccacuccugccccaccccacccuugucccuggccauugccugguggucuagaaacacuuaaaacuugaaguagugacaccuaccugcggucauauuguagagagaugcucaguguuaaaacugaaacacacaaacacacacacacacacauuuuucucuuguagauuuuaauuuuuuaagugggaaagaacucaccuugccuuccucccccaaaugugcaaccuguaaaaggucucuccacaccaggggccaggauccaguucccucaucucuggcaggaaagauccacagcuuuuccuccaugucuguuacucacuuucagcaguccggguaaaaucuguggaucaggguuaaaaaagcaccguggagaauggcccucuucaggaaagaaaaauaagcaaaugaaugguccaccuagggguucaguaaagaaagaaauguguuaacugagccugaaucccuucugggaaguaauaaugaccauugacaacuaagaaguagacaccaugcuaaagacuuacauacaaucuccuugaaucuucucaauagcccauugacuuagaaacuguuacuuucccauuuuacacacagugaaacugaggcucagauauaaaggaaagguacuggcuugaagucacaaccacgacaggaguaaggauuuggaauaaggauuugguccuguuuucuggaccaaauccuuacucuggcucugcuuacacuuucucuccaucaccaaauccuuacuccaaauccagaagucagagccaacucccaucuugguucugacccaaauccugcucuggacucuggagaggagauugaaauauaauugcacccucauacacauuuaggaaaugguuaagaaguguaaacugaacccuuauccuugucuucaaucuuccucccuguagacaucuaucuuauuaugguuauuauucagaaaacccagggauacagguuugucuucuuacuuugauaacucuucuuaguuuaaaauaauaauaauaacacaucuuuggucaucuaugucacacaaaaauuuuccuuuguuugcggggggcuggggaugcaguguuuuuuggggggucuugguuuaugcucccugcccuugagccccucagccguuugcccugcccccaccucggcuccauggugggagggggcucuggucuuuucuaaagugggcgguuugucuuuugaucuuucccuuuuggaugugcgugugugucugcgugugccaugugcguggcacgcauaugagugugugugcgugugaacggcuuuggguccugcugguuuugcugugagcugcaguguucugugggucugugguaucugacacuguggacauuaauguacuucuuggacauuuuaauaaauuuuuuaacaguucaaccugcccgucaccaccuga

SEQ ID NO: 181 - RNA, 8169 nt, Homo_Sapiens
acagccgggcuggagcgcgcacccggcacugaggcuucgcugcucucggagcgcucagaccgcggccgccgcagccggcgaaagaggcaaagucccgcacgccggaggacaugcgccucggcuagcggccccgggccccaccaccgugcggcuuucuccagauuauuccucucucgcugucucugacugucucucucugucucugucucugucucucucucucucacacacacacacacacacacaaacacacauacgcacgcacgaucucacuucgaucuauacacuggaggauuaaaacaaacaaacaaaaaaaacauuuccuucgcucccccucccucuccacucugagaagcagaggagccgcacggcgaggggccgcagaccgucuggaaaugcgaauccuaaagcguuuccucgcuugcauucagcuccucuguguuugccgccuggauugggcuaauggauacuacagacaacagagaaaacuuguugaagagauuggcugguccuauacaggagcacugaaucaaaaaaauuggggaaagaaauauccaacauguaauagcccaaaacaaucuccuaucaauauugaugaagaucuuacacaaguaaaugugaaucuuaagaaacuuaaauuucaggguugggauaaaacaucauuggaaaacacauucauucauaacacugggaaaacaguggaaauuaaucucacuaaugacuaccgugucagcggaggaguuucagaaaugguguuuaaagcaagcaagauaacuuuucacuggggaaaaugcaauaugucaucugauggaucagagcauaguuuagaaggacaaaaauuuccacuugagaugcaaaucuacugcuuugaugcggaccgauuuucaaguuuugaggaagcagucaaaggaaaagggaaguuaagagcuuuauccauuuuguuugagguugggacagaagaaaauuuggauuucaaagcgauuauugauggagucgaaaguguuagucguuuugggaagcaggcugcuuuagauccauucauacuguugaaccuucugccaaacucaacugacaaguauuacauuuacaauggcucauugacaucuccucccugcacagacacaguugacuggauuguuuuuaaagauacaguuagcaucucugaaagccaguuggcuguuuuuugugaaguucuuacaaugcaacaaucugguuaugucaugcugauggacuacuuacaaaacaauuuucgagagcaacaguacaaguucucuagacagguguuuuccucauacacuggaaaggaagagauucaugaagcaguuuguaguucagaaccagaaaauguucaggcugacccagagaauuauaccagccuucuuguuacaugggaaagaccucgagucguuuaugauaccaugauugagaaguuugcaguuuuguaccagcaguuggauggagaggaccaaaccaagcaugaauuuuugacagauggcuaucaagacuugggugcuauucucaauaauuugcuacccaauaugaguuauguucuucagauaguagccauaugcacuaauggcuuauauggaaaauacagcgaccaacugauugucgacaugccuacugauaauccugaacuugaucuuuucccugaauuaauuggaacugaagaaauaaucaaggaggaggaagagggaaaagacauugaagaaggcgcuauugugaauccugguagagacagugcuacaaaccaaaucaggaaaaaggaaccccagauuucuaccacaacacacuacaaucgcauagggacgaaauacaaugaagccaagacuaaccgauccccaacaagaggaagugaauucucuggaaagggugauguucccaauacaucuuuaaauuccacuucccaaccagucacuaaauuagccacagaaaaagauauuuccuugacuucucagacugugacugaacugccaccucacacuguggaagguacuucagccucuuuaaaugauggcucuaaaacuguucuuagaucuccacauaugaacuugucggggacugcagaauccuuaaauacaguuucuauaacagaauaugaggaggagaguuuauugaccaguuucaagcuugauacuggagcugaagauucuucaggcuccagucccgcaacuucugcuaucccauucaucucugagaacauaucccaaggguauauauuuuccuccgaaaacccagagacaauaacauaugauguccuuauaccagaaucugcuagaaaugcuuccgaagauucaacuucaucagguucagaagaaucacuaaaggauccuucuauggagggaaaugugugguuuccuagcucuacagacauaacagcacagcccgauguuggaucaggcagagagagcuuucuccagacuaauuacacugagauacguguugaugaaucugagaagacaaccaaguccuuuucugcaggcccagugaugucacagggucccucaguuacagaucuggaaaugccacauuauucuaccuuugccuacuucccaacugagguaacaccucaugcuuuuaccccauccuccagacaacaggauuuggucuccacggucaacgugguauacucgcagacaacccaaccgguauacaauggugagacaccucuucaaccuuccuacaguagugaagucuuuccucuagucaccccuuuguugcuugacaaucagauccucaacacuaccccugcugcuucaaguagugauucggccuugcaugcuacgccuguauuucccagugucgaugugucauuugaauccauccugucuuccuaugauggugcaccuuugcuuccauuuuccucugcuuccuucaguagugaauuguuucgccaucugcauacaguuucucaaauccuuccacaaguuacuucagcuaccgagagugauaaggugcccuugcaugcuucucugccaguggcugggggugauuugcuauuagagcccagccuugcucaguauucugaugugcuguccacuacucaugcugcuucagagacgcuggaauuugguagugaaucugguguucuuuauaaaacgcuuauguuuucucaaguugaaccacccagcagugaugccaugaugcaugcacguucuucagggccugaaccuucuuaugccuugucugauaaugagggcucccaacacaucuucacuguuucuuacaguucugcaauaccugugcaugauucuguggguguaacuuaucaggguuccuuauuuagcggcccuagccauauaccaauaccuaagucuucguuaauaaccccaacugcaucauuacugcagccuacucaugcccucucuggugauggggaauggucuggagccucuucugauagugaauuucuuuuaccugacacagaugggcugacagcccuuaacauuucuucaccuguuucuguagcugaauuuacauauacaacaucuguguuuggugaugauaauaaggcgcuuucuaaaagugaaauaauauauggaaaugagacugaacugcaaauuccuucuuucaaugagaugguuuacccuucugaaagcacagucaugcccaacauguaugauaauguaaauaaguugaaugcgucuuuacaagaaaccucuguuuccauuucuagcaccaagggcauguuuccagggucccuugcucauaccaccacuaagguuuuugaucaugagauuagucaaguuccagaaaauaacuuuucaguucaaccuacacauacugucucucaagcaucuggugacacuucgcuuaaaccugugcuuagugcaaacucagagccagcauccucugacccugcuucuagugaaauguuaucuccuucaacucagcucuuauuuuaugagaccucagcuucuuuuaguacugaaguauugcuacaaccuuccuuucaggcuucugauguugacaccuugcuuaaaacuguucuuccagcugugcccagugauccaauauugguugaaacccccaaaguugauaaaauuaguucuacaauguugcaucucauuguaucaaauucugcuucaagugaaaacaugcugcacucuacaucuguaccaguuuuugaugugucgccuacuucucauaugcacucugcuucacuucaagguuugaccauuuccuaugcaagugagaaauaugaaccaguuuuguuaaaaagugaaaguucccaccaagugguaccuucuuuguacaguaaugaugaguuguuccaaacggccaauuuggagauuaaccaggcccaucccccaaaaggaaggcauguauuugcuacaccuguuuuaucaauugaugaaccauuaaauacacuaauaaauaagcuuauacauuccgaugaaauuuuaaccuccaccaaaaguucuguuacugguaagguauuugcugguauuccaacaguugcuucugauacauuuguaucuacugaucauucuguuccuauaggaaaugggcauguugccauuacagcuguuucuccccacagagaugguucuguaaccucaacaaaguugcuguuuccuucuaaggcaacuucugagcugagucauagugccaaaucugaugccgguuuagugggugguggugaagauggugacacugaugaugauggugaugaugaugaugaugacagagguagugauggcuuauccauucauaaguguaugucaugcucauccuauagagaaucacaggaaaagguaaugaaugauucagacacccacgaaaacagucuuauggaucagaauaauccaaucucauacucacuaucugagaauucugaagaagauaauagagucacaaguguauccucagacagucaaacugguauggacagaaguccugguaaaucaccaucagcaaaugggcuaucccaaaagcacaaugauggaaaagaggaaaaugacauucagacugguagugcucugcuuccucucagcccugaaucuaaagcaugggcaguucugacaagugaugaagaaaguggaucagggcaagguaccucagauagccuuaaugagaaugagacuuccacagauuucaguuuugcagacacuaaugaaaaagaugcugaugggauccuggcagcaggugacucagaaauaacuccuggauucccacaguccccaacaucaucuguuacuagcgagaacucagaaguguuccacguuucagaggcagaggccaguaauaguagccaugagucucguauuggucuagcugagggguuggaauccgagaagaaggcaguuauaccccuugugaucgugucagcccugacuuuuaucugucuagugguucuuguggguauucucaucuacuggaggaaaugcuuccagacugcacacuuuuacuuagaggacaguacauccccuagaguuauauccacaccuccaacaccuaucuuuccaauuucagaugaugucggagcaauuccaauaaagcacuuuccaaagcauguugcagauuuacaugcaaguaguggguuuacugaagaauuugagacacugaaagaguuuuaccaggaagugcagagcuguacuguugacuuagguauuacagcagacagcuccaaccacccagacaacaagcacaagaaucgauacauaaauaucguugccuaugaucauagcaggguuaagcuagcacagcuugcugaaaaggauggcaaacugacugauuauaucaaugccaauuauguugauggcuacaacagaccaaaagcuuauauugcugcccaaggcccacugaaauccacagcugaagauuucuggagaaugauaugggaacauaauguggaaguuauugucaugauaacaaaccucguggagaaaggaaggagaaaaugugaucaguacuggccugccgaugggagugaggaguacgggaacuuucuggucacucagaagagugugcaagugcuugccuauuauacugugaggaauuuuacucuaagaaacacaaaaauaaaaaagggcucccagaaaggaagacccaguggacguguggucacacaguaucacuacacgcaguggccugacaugggaguaccagaguacucccugccagugcugaccuuugugagaaaggcagccuaugccaagcgccaugcaguggggccuguugucguccacugcagugcuggaguuggaagaacaggcacauauauugugcuagacaguauguugcagcagauucaacacgaaggaacugucaacauauuuggcuucuuaaaacacauccguucacaaagaaauuauuugguacaaacugaggagcaauaugucuucauucaugauacacugguugaggccauacuuaguaaagaaacugaggugcuggacagucauauucaugccuauguuaaugcacuccucauuccuggaccagcaggcaaaacaaagcuagagaaacaauuccagcuccugagccagucaaauauacagcagagugacuauucugcagcccuaaagcaaugcaacagggaaaagaaucgaacuucuucuaucaucccuguggaaagaucaaggguuggcauuucaucccugaguggagaaggcacagacuacaucaaugccuccuauaucaugggcuauuaccagagcaaugaauucaucauuacccagcacccucuccuucauaccaucaaggauuucuggaggaugauaugggaccauaaugcccaacuggugguuaugauuccugauggccaaaacauggcagaagaugaauuuguuuacuggccaaauaaagaugagccuauaaauugugagagcuuuaaggucacucuuauggcugaagaacacaaaugucuaucuaaugaggaaaaacuuauaauucaggacuuuaucuuagaagcuacacaggaugauuauguacuugaagugaggcacuuucaguguccuaaauggccaaauccagauagccccauuaguaaaacuuuugaacuuauaaguguuauaaaagaagaagcugccaauagggaugggccuaugauuguucaugaugagcauggaggagugacggcaggaacuuucugugcucugacaacccuuaugcaccaacuagaaaaagaaaauuccguggauguuuaccagguagccaagaugaucaaucugaugaggccaggagucuuugcugacauugagcaguaucaguuucucuacaaagugauccucagccuugugagcacaaggcaggaagagaauccauccaccucucuggacaguaauggugcagcauugccugauggaaauauagcugagagcuuagagucuuuaguuuaacacagaaaggggugggggaacucacaucugagcauuguuuuccucuuccuaaaauuaggcaggaaaaucagucuaguucuguuaucuguugauuucccaucaccugacaguaacuuucaugacauaggauucugccgccaaauuuauaucauuaacaaugugugccuuuuugcaagacuuguaauuuacuuauuauguuugaacuaaaaugauugaauuuuacaguauuucuaagaauggaauugugguauuuuuuucuguauugauuuuaacagaaaauuucaauuuauagagguuaggaauuccaaacuacagaaaauguuuguuuuuagugucaaauuuuuagcuguauuuguagcaauuaucagguuugcuagaaauauaacuuuuaauacaguagccuguaaauaaaacacucuuccauaugauauucaacauuuuacaacugcaguauucaccuaaaguagaaauaaucuguuacuuauuguaaauacugcccuagugucuccauggaccaaauuuauauuuauaauuguagauuuuuauauuuuacuacugagucaaguuuucuaguucuguguaauuguuuaguuuaaugacguaguucauuagcuggucuuacucuaccaguuuucugacauuguauuguguuaccuaagucauuaacuuuguuucagcauguaauuuuaacuuuuguggaaaauagaaauaccuucauuuugaaagaaguuuuuaugagaauaacaccuuaccaaacauuguucaaaugguuuuuauccaaggaauugcaaaaauaaauauaaauauugccauuaaaaaaaaaaaa

SEQ ID NO: 182 - RNA, 7616 nt, Homo_Sapiens
auuacagaggaaggagcucgcuauauaagccagccaaaguuggcugcaccggccacagccugccuacugucacccgccucucccgcgcgcagauacacgcccccgccuccgugggcacaaaggcagcgcugcuggggaacucgggggaacgcgcacgugggaaccgccgcagcuccacacuccagguacuucuuccaaggaccuaggucucucgcccaucggaaagaaaauaauucuuucaagaagaucagggacaacugauuugaagucuacucugugcuucuaaauccccaauucugcugaaagugagauacccuagagcccuagagccccagcagcacccagccaaacccaccuccaccaugggggccaugacucagcuguuggcaggugucuuucuugcuuuccuugcccucgcuaccgaaggugggguccucaagaaagucauccggcacaagcgacagaguggggugaacgccacccugccagaagagaaccagccagugguguuuaaccacguuuacaacaucaagcugccagugggaucccaguguucgguggaucuggagucagccaguggggagaaagaccuggcaccgccuucagagcccagcgaaagcuuucaggagcacacaguggauggggaaaaccagauugucuucacacaucgcaucaacaucccccgccgggccuguggcugugccgcagccccugauguuaaggagcugcugagcagacuggaggagcuggagaaccuggugucuucccugagggagcaauguacugcaggagcaggcugcugucuccagccugccacaggccgcuuggacaccaggcccuucuguagcggucggggcaacuucagcacugaaggauguggcugugucugcgaaccuggcuggaaaggccccaacugcucugagcccgaauguccaggcaacugucaccuucgaggccggugcauugaugggcagugcaucugugacgacggcuucacgggcgaggacugcagccagcuggcuugccccagcgacugcaaugaccagggcaagugcguaaauggagucugcaucuguuucgaaggcuacgccggggcugacugcagccgugaaaucugcccagugcccugcagugaggagcacggcacauguguagauggcuugugugugugccacgauggcuuugcaggcgaugacugcaacaagccucugugucucaacaauugcuacaaccguggacgaugcguggagaaugagugcgugugugaugaggguuucacgggcgaagacugcagugagcucaucugccccaaugacugcuucgaccggggccgcugcaucaauggcaccugcuacugcgaagaaggcuucacaggugaagacugcgggaaacccaccugcccacaugccugccacacccagggccggugugaggaggggcaguguguaugugaugagggcuuugccgguguggacugcagcgagaagagguguccugcugacugucacaaucguggccgcuguguagacgggcggugugagugugaugaugguuucacuggagcugacuguggggagcucaagugucccaauggcugcaguggccauggccgcugugucaaugggcagugugugugugaugagggcuauacuggggaggacugcagccagcuacggugccccaaugacugucacagucggggccgcugugucgagggcaaauguguaugugagcaaggcuucaagggcuaugacugcagugacaugagcugcccuaaugacugucaccagcacggccgcugugugaauggcauguguguuugugaugacggcuacacaggggaagacugccgggaucgccaaugccccagggacugcagcaacaggggccucuguguggacggacagugcgucugugaggacggcuucaccggcccugacugugcagaacucuccuguccaaaugacugccauggccagggucgcugugugaaugggcagugcgugugccaugaaggauuuaugggcaaagacugcaaggagcaaagaugucccagugacugucauggccagggccgcugcguggacggccagugcaucugccacgagggcuucacaggccuggacuguggccagcacuccugccccagugacugcaacaacuuaggacaaugcgucucgggccgcugcaucugcaacgagggcuacagcggagaagacugcucagaggugucuccucccaaagaccucguugugacagaagugacggaagagacggucaaccuggccugggacaaugagaugcgggucacagaguaccuugucguguacacgcccacccacgaggguggucuggaaaugcaguuccgugugccuggggaccagacguccaccaucauccaggagcuggagccugguguggaguacuuuauccguguauuugccauccuggagaacaagaagagcauuccugucagcgccaggguggccacguacuuaccugcaccugaaggccugaaauucaaguccaucaaggagacaucuguggaaguggagugggauccucuagacauugcuuuugaaaccugggagaucaucuuccggaauaugaauaaagaagaugagggagagaucaccaaaagccugaggaggccagagaccucuuaccggcaaacuggucuagcuccugggcaagaguaugagauaucucugcacauagugaaaaacaauacccggggcccuggccugaagagggugaccaccacacgcuuggaugcccccagccagaucgaggugaaagaugucacagacaccacugccuugaucaccugguucaagccccuggcugagaucgauggcauugagcugaccuacggcaucaaagacgugccaggagaccguaccaccaucgaucucacagaggacgagaaccaguacuccaucgggaaccugaagccugacacugaguacgaggugucccucaucucccgcagaggugacaugucaagcaacccagccaaagagaccuucacaacaggccucgaugcucccaggaaucuucgacguguuucccagacagauaacagcaucacccuggaauggaggaauggcaaggcagcuauugacaguuacagaauuaaguaugcccccaucucuggaggggaccacgcugagguugauguuccaaagagccaacaagccacaaccaaaaccacacucacaggucugaggccgggaacugaauaugggauuggaguuucugcugugaaggaagacaaggagagcaauccagcgaccaucaacgcagccacagaguuggacacgcccaaggaccuucagguuucugaaacugcagagaccagccugacccugcucuggaagacaccguuggccaaauuugaccgcuaccgccucaauuacagucuccccacaggccagugggugggagugcagcuuccaagaaacaccacuuccuauguccugagaggccuggaaccaggacaggaguacaauguccuccugacagccgagaaaggcagacacaagagcaagcccgcacgugugaaggcauccacugaacaagccccugagcuggaaaaccucaccgugacugagguuggcugggauggccucagacucaacuggaccgcagcugaccaggccuaugagcacuuuaucauucaggugcaggaggccaacaagguggaggcagcucggaaccucaccgugccuggcagccuucgggcuguggacauaccgggccucaaggcugcuacgccuuauacagucuccaucuauggggugauccagggcuauagaacaccagugcucucugcugaggccuccacaggggaaacucccaauuugggagaggucgugguggccgaggugggcugggaugcccucaaacucaacuggacugcuccagaaggggccuaugaguacuuuuucauucaggugcaggaggcugacacaguagaggcagcccagaaccucaccgucccaggaggacugagguccacagaccugccugggcucaaagcagccacucauuauaccaucaccauccgcggggucacucaggacuucagcacaaccccucucucuguugaagucuugacagaggagguuccagauaugggaaaccucacagugaccgagguuagcugggaugcucucagacugaacuggaccacgccagauggaaccuaugaccaguuuacuauucagguccaggaggcugaccagguggaagaggcucacaaucucacgguuccuggcagccugcguuccauggaaaucccaggccucagggcuggcacuccuuacacagucacccugcacggcgaggucaggggccacagcacucgaccccuugcuguagaggucgucacagaggaucucccacagcugggagauuuagccgugucugagguuggcugggauggccucagacucaacuggaccgcagcugacaaugccuaugagcacuuugucauucaggugcaggaggucaacaaaguggaggcagcccagaaccucacguugccuggcagccucagggcuguggacaucccgggccucgaggcugccacgccuuauagagucuccaucuauggggugauccggggcuauagaacaccaguacucucugcugaggccuccacagccaaagaaccugaaauuggaaacuuaaauguuucugacauaacucccgagagcuucaaucucuccuggauggcuaccgaugggaucuucgagaccuuuaccauugaaauuauugauuccaauagguugcuggagacuguggaauauaauaucucuggugcugaacgaacugcccauaucucagggcuacccccuaguacugauuuuauugucuaccucucuggacuugcucccagcauccggaccaaaaccaucagugccacagccacgacagaggcccugccccuucuggaaaaccuaaccauuuccgacauuaaucccuacggguucacaguuuccuggauggcaucggagaaugccuuugacagcuuucuaguaacggugguggauucugggaagcugcuggacccccaggaauucacacuuucaggaacccagaggaagcuggagcuuagaggccucauaacuggcauuggcuaugagguuauggucucuggcuucacccaagggcaucaaaccaagcccuugagggcugagauuguuacagaagccgaaccggaaguugacaaccuucugguuucagaugccaccccagacgguuuccgucuguccuggacagcugaugaaggggucuucgacaauuuuguucucaaaaucagagauaccaaaaagcagucugagccacuggaaauaacccuacuugcccccgaacguaccagggacauaacaggucucagagaggcuacugaauacgaaauugaacucuauggaauaagcaaaggaaggcgaucccagacagucagugcuauagcaacaacagccaugggcuccccaaaggaagucauuuucucagacaucacugaaaauucggcuacugucagcuggagggcacccacagcccaaguggagagcuuccggauuaccuaugugcccauuacaggagguacacccuccaugguaacuguggacggaaccaagacucagaccaggcuggugaaacucauaccuggcguggaguaccuugucagcaucaucgccaugaagggcuuugaggaaagugaaccugucucagggucauucaccacagcucuggauggcccaucuggccuggugacagccaacaucacugacucagaagccuuggccagguggcagccagccauugccacuguggacaguuaugucaucuccuacacaggcgagaaagugccagaaauuacacgcacgguguccgggaacacaguggaguaugcucugaccgaccucgagccugccacggaauacacacugagaaucuuugcagagaaagggccccagaagagcucaaccaucacugccaaguucacaacagaccucgauucuccaagagacuugacugcuacugagguucagucggaaacugcccuccuuaccuggcgacccccccgggcaucagucaccgguuaccugcuggucuaugaaucaguggauggcacagucaaggaagucauuguggguccagauaccaccuccuacagccuggcagaccugagcccauccacccacuacacagccaagauccaggcacucaaugggccccugaggagcaauaugauccagaccaucuucaccacaauuggacuccuguaccccuuccccaaggacugcucccaagcaaugcugaauggagacacgaccucuggccucuacaccauuuaucugaauggugauaaggcugaggcgcuggaagucuucugugacaugaccucugauggggguggauggauuguguuccugagacgcaaaaacggacgcgagaacuucuaccaaaacuggaaggcauaugcugcuggauuuggggaccgcagagaagaauucuggcuugggcuggacaaccugaacaaaaucacagcccaggggcaguacgagcuccggguggaccugcgggaccauggggagacagccuuugcugucuaugacaaguucagcgugggagaugccaagacucgcuacaagcugaagguggagggguacagugggacagcaggugacuccauggccuaccacaauggcagauccuucuccaccuuugacaaggacacagauucagccaucaccaacugugcucuguccuacaaaggggcuuucugguacaggaacugucaccgugucaaccugauggggagauauggggacaauaaccacagucagggcguuaacugguuccacuggaagggccacgaacacucaauccaguuugcugagaugaagcugagaccaagcaacuucagaaaucuugaaggcaggcgcaaacgggcauaaauuccagggaccacugggugagagaggaauaaggcccagagcgaggaaaggauuuuaccaaagcaucaauacaaccagcccaaccaucgguccacaccugggcauuuggugagagucaaagcugaccauggaucccuggggccaacggcaacagcaugggccucaccuccucugugauuucuuucuuugcaccaaagacaucagucuccaacauguuucuguuuuguuguuugauucagcaaaaaucucccagugacaacaucgcaauaguuuuuuacuucucuuagguggcucugggaaugggagagggguaggauguacagggguaguuuguuuuagaaccagccguauuuuacaugaagcuguauaauuaauugucauuauuuuuguuagcaaagauuaaaugugucauuggaagccaucccuuuuuuuacauuucauacaacagaaaccagaaaagcaauacuguuuccauuuuaaggauaugauuaauauuauuaauauaauaaugaugaugaugaugaugaaaacuaaggauuuuucaagagaucuuucuuuccaaaacauuucuggacaguaccugauuguauuuuuuuuuuaaauaaaagcacaaguacuuuugaguuuguuaaaaaaaaaaaaaaaaaa

SEQ ID NO: 183 - RNA, 5895 nt, Homo_Sapiens
gcaguuggugaaacuccucugucucccgcucaucuuuucauugcucguuccccuccuucccgcagacacccggaccuccccugggcgccagcuccgcggcuccaacggguccagaaacaagccggauuuuuuuuuuuucuuccuggaaauuggcuuugguguguguugcccuaccucccuccucccccucccacccacagcccccccccggccuuuuuuuuuuuuuuuuuuuuuuuugagacauggcccgggcaguggcuccuggaagaggaacaagugugggaaaagggagaggaagccggagcuaaaugacaggaugcaggcgacuugagacacaaaaagagaagcguuccucucggauccaggcauugccucgcugcuuucuuuucuccaagacgggcugaggauuguacagcucuaggcggaguuggggcucuucggaucgcuuagauucuccucuuugcugcauuuccccccacguccucguucucccgcgucugccugcggacccggagaagggagaauggagagggggcugccgcuccucugcgccgugcucgcccucguccucgccccggccggcgcuuuucgcaacgauaaauguggcgauacuauaaaaauugaaagccccggguaccuuacaucuccugguuauccucauucuuaucacccaagugaaaaaugcgaauggcugauucaggcuccggacccauaccagagaauuaugaucaacuucaacccucacuucgauuuggaggacagagacugcaaguaugacuacguggaagucuucgauggagaaaaugaaaauggacauuuuaggggaaaguucuguggaaagauagccccuccuccuguugugucuucagggccauuucuuuuuaucaaauuugucucugacuacgaaacacauggugcaggauuuuccauacguuaugaaauuuucaagagagguccugaauguucccagaacuacacaacaccuaguggagugauaaagucccccggauucccugaaaaauaucccaacagccuugaaugcacuuauauugucuuugcgccaaagaugucagagauuauccuggaauuugaaagcuuugaccuggagccugacucaaauccuccaggggggauguucugucgcuacgaccggcuagaaaucugggauggauucccugauguuggcccucacauugggcguuacuguggacagaaaacaccaggucgaauccgauccucaucgggcauucucuccaugguuuuuuacaccgacagcgcgauagcaaaagaagguuucucagcaaacuacagugucuugcagagcagugucucagaagauuucaaauguauggaagcucugggcauggaaucaggagaaauucauucugaccagaucacagcuucuucccaguauagcaccaacuggucugcagagcgcucccgccugaacuacccugagaauggguggacucccggagaggauuccuaccgagaguggauacagguagacuugggccuucugcgcuuugucacggcugucgggacacagggcgccauuucaaaagaaaccaagaagaaauauuaugucaagacuuacaagaucgacguuagcuccaacggggaagacuggaucaccauaaaagaaggaaacaaaccuguucucuuucagggaaacaccaaccccacagauguugugguugcaguauuccccaaaccacugauaacucgauuuguccgaaucaagccugcaacuugggaaacuggcauaucuaugagauuugaaguauacgguugcaagauaacagauuauccuugcucuggaauguuggguauggugucuggacuuauuucugacucccagaucacaucauccaaccaaggggacagaaacuggaugccugaaaacauccgccugguaaccagucgcucuggcugggcacuuccacccgcaccucauuccuacaucaaugaguggcuccaaauagaccugggggaggagaagaucgugaggggcaucaucauucagggugggaagcaccgagagaacaagguguucaugaggaaguucaagaucggguacagcaacaacggcucggacuggaagaugaucauggaugacagcaaacgcaaggcgaagucuuuugagggcaacaacaacuaugauacaccugagcugcggacuuuuccagcucucuccacgcgauucaucaggaucuaccccgagagagccacucauggcggacuggggcucagaauggagcugcugggcugugaaguggaagccccuacagcuggaccgaccacucccaacgggaacuugguggaugaaugugaugacgaccaggccaacugccacaguggaacaggugaugacuuccagcucacagguggcaccacugugcuggccacagaaaagcccacggucauagacagcaccauacaaucagaguuuccaacauaugguuuuaacugugaauuuggcuggggcucucacaagaccuucugccacugggaacaugacaaucacgugcagcucaaguggaguguguugaccagcaagacgggacccauucaggaucacacaggagauggcaacuucaucuauucccaagcugacgaaaaucagaagggcaaaguggcucgccuggugagcccugugguuuauucccagaacucugcccacugcaugaccuucugguaucacaugucugggucccacgucggcacacucagggucaaacugcgcuaccagaagccagaggaguacgaucagcuggucuggauggccauuggacaccaaggugaccacuggaaggaagggcgugucuugcuccacaagucucugaaacuuuaucaggugauuuucgagggcgaaaucggaaaaggaaaccuuggugggauugcuguggaugacauuaguauuaauaaccacauuucacaagaagauugugcaaaaccagcagaccuggauaaaaagaacccagaaauuaaaauugaugaaacagggagcacgccaggauacgaaggugaaggagaaggugacaagaacaucuccaggaagccaggcaauguguugaagaccuuagaccccauccucaucaccaucauagccaugagugcccuggggguccuccugggggcugucuguggggucgugcuguacugugccuguuggcauaaugggaugucagaaagaaacuugucugcccuggagaacuauaacuuugaacuuguggauggugugaaguugaaaaaagacaaacugaauacacagaguacuuauucggaggcaugaaggcagacagagaugaaaagacagucaaaggacggaaguggaaggacgggagugagcuggggagcuguugaucuuucacuauacaggcugggaaguguguugaugaccacugagccaggcuuuucucaggagcuucaaugaguauggccgacagacauggacaaggagcuguguucaccaucggacucaugugcagucagcuuuuuuccuguugguuucauuugaauaaucagaugcugguguugagaccaaguaugauugacauaaucauucauuucgaccccuccugccccucucucucucucuccucuccccuuuguggauucuuuuuggaaacugagcgaaauccaagaugcuggcaccaagcguauuccguguggcccuuuggauggacaugcuaccugaaacccagugcccagaauauacuagaaucaccgcauuucaguggacuccugaaguuguacuuguguauaauugcccgcgucgugcauaggcaaagaaggauuaggcuguuuucuuuuuaaaguacuguagccucaguacugguguagugugucagcucuguuuacgaagcaauacuguccaguuuucuugcuguuuuuccgguguuguacuaaaccucgugcuugugaacuccauacagaaaacggugccaucccugaacacggcuggccacuggguauacugcugacaaccgcaacaacaaaaacacaaauccuuggcacuggcuagucuauguccucucaagugccuuuuuguuuguacugguucauuguguuacauuaacgacccacucugcuucuugcuggugaaagcccugcucuuuaaucaaacucugguggcccacugacuaagaagaaaguuuauuuucgugugagaugccagccccuccgggcaggcaagggcucugaagauuuggcaacguggcuuaauuguucugcuuuuucuguaguucaauuucauguuucuugacccuuuuguauaaagcuacaauauucucucuuauuguucuuucauauggaauguauuuucaaauguaaacucucuucucuuucucucuccuaucucucugucuuuuuucucucuuagaauuggaggauuugccauuguccaggaaagaaacuugcagcuuuaaccugcugggaauggcaaacgauuuuacuagacuuuauguuuaaaaauaaauaaauaagggaaauuccuaacuuugcccuccaaagucuaacuuugguuuucuuguuaacugguuaaagugacaguaucuuuuuuccuuaucuauucuauucaaaaugaccuuugauagaaauguuggcauuuaguagaaauagugauaaguugaggaaagaaauaauacaaauuggcuuucaagugagacccaaaggaagaacuggauaaaaucuuccaaauccaaaagcaugagauuuuucuauccaaauaugcaaaaaugacccaagagaacuuucuuauuuugcuacugagucacacaagggaaguggaaggaagaacaguuaauuuaagaaugaaacuauaaauccugaugccugggggucaaguauuuuaagauaagagggggaaaaacacauaaagucaaacaaauguuuuaaaaauucauaacagcaaccuugaaaaaauagacuuaaaugaaugcuucuagaaacuuccagcggcucacaaagaauaagccugccuuagggcuggcaacaucuaagccucuaacagcacagggaagcaaauaucuuaccaggcagccuaugaauuaacccaaagaagcuuugguugguuuugguggauuuuuaucaugccauguuggacaugagauuuuuuagaucuuccuucccacauugcuagacgucucacucaaagacauuuguugggagucacauuugcaucauagacgagacaguccauucaucuuaguuaaauuggauugagaaugccuuuuguuuccaggaaaauauugaucaccaugaaagaagaauaguuuuuuguccccagagacauucauuuaguugauauaauccuaccagaaggaaagcacuaagaaacacucguuuguuguuuuuaaaggcaacagacuuaaaguuguccucagccaaggaaaaaugauacugcaacuuuaaaauuuaaaguaucuugcacugauaaauauauuuaaaaauuauauguuuauaaaguuauuaauuuguaaaggcaguguuacaaaauguucaguuuauauuguuuuagauuguuuuguaauuuuuaaagguguaaaauaacauauuuuuucuuuauggaaaucuauaaaacuuucuguaguaaaauguuuucauuuuacugguauauuauugcuucauguuuuguaccaucauaagauuuugugcagauuuuuuuuacagaaauuauuauuuucuaugacaauaugacacuuguaaauuguuguuucaaaaugaacagcgaagccuuaacuuuaaaugacauuuguauucucagacacugaguagcauaaaaaccacauagaacugaacuguaacuuaaauuccaaacuaugacuacuacauuccaaagaaacaguugaauuaaacauuuucauaaaauaucccacaaaaaaaaaaaaaaaa

SEQ ID NO: 184 - RNA, 2478 nt, Homo_Sapiens
gcaguuggugaaacuccucugucucccgcucaucuuuucauugcucguuccccuccuucccgcagacacccggaccuccccugggcgccagcuccgcggcuccaacggguccagaaacaagccggauuuuuuuuuuuucuuccuggaaauuggcuuugguguguguugcccuaccucccuccucccccucccacccacagcccccccccggccuuuuuuuuuuuuuuuuuuuuuuuugagacauggcccgggcaguggcuccuggaagaggaacaagugugggaaaagggagaggaagccggagcuaaaugacaggaugcaggcgacuugagacacaaaaagagaagcguuccucucggauccaggcauugccucgcugcuuucuuuucuccaagacgggcugaggauuguacagcucuaggcggaguuggggcucuucggaucgcuuagauucuccucuuugcugcauuuccccccacguccucguucucccgcgucugccugcggacccggagaagggagaauggagagggggcugccgcuccucugcgccgugcucgcccucguccucgccccggccggcgcuuuucgcaacgauaaauguggcgauacuauaaaaauugaaagccccggguaccuuacaucuccugguuauccucauucuuaucacccaagugaaaaaugcgaauggcugauucaggcuccggacccauaccagagaauuaugaucaacuucaacccucacuucgauuuggaggacagagacugcaaguaugacuacguggaagucuucgauggagaaaaugaaaauggacauuuuaggggaaaguucuguggaaagauagccccuccuccuguugugucuucagggccauuucuuuuuaucaaauuugucucugacuacgaaacacauggugcaggauuuuccauacguuaugaaauuuucaagagagguccugaauguucccagaacuacacaacaccuaguggagugauaaagucccccggauucccugaaaaauaucccaacagccuugaaugcacuuauauugucuuugcgccaaagaugucagagauuauccuggaauuugaaagcuuugaccuggagccugacucaaauccuccaggggggauguucugucgcuacgaccggcuagaaaucugggauggauucccugauguuggcccucacauugggcguuacuguggacagaaaacaccaggucgaauccgauccucaucgggcauucucuccaugguuuuuuacaccgacagcgcgauagcaaaagaagguuucucagcaaacuacagugucuugcagagcagugucucagaagauuucaaauguauggaagcucugggcauggaaucaggagaaauucauucugaccagaucacagcuucuucccaguauagcaccaacuggucugcagagcgcucccgccugaacuacccugagaauggguggacucccggagaggauuccuaccgagaguggauacagguagacuugggccuucugcgcuuugucacggcugucgggacacagggcgccauuucaaaagaaaccaagaagaaauauuaugucaagacuuacaagaucgacguuagcuccaacggggaagacuggaucaccauaaaagaaggaaacaaaccuguucucuuucagggaaacaccaaccccacagauguugugguugcaguauuccccaaaccacugauaacucgauuuguccgaaucaagccugcaacuugggaaacuggcauaucuaugagauuugaaguauacgguugcaagauaacagauuauccuugcucuggaauguuggguauggugucuggacuuauuucugacucccagaucacaucauccaaccaaggggacagaaacuggaugccugaaaacauccgccugguaaccagucgcucuggcugggcacuuccacccgcaccucauuccuacaucaaugaguggcuccaaauagaccugggggaggagaagaucgugaggggcaucaucauucagggugggaagcaccgagagaacaagguguucaugaggaaguucaagaucggguacagcaacaacggcucggacuggaagaugaucauggaugacagcaaacgcaaggcgaagucuuuugagggcaacaacaacuaugauacaccugagcugcggacuuuuccagcucucuccacgcgauucaucaggaucuaccccgagagagccacucauggcggacuggggcucagaauggagcugcugggcugugaaguggaagccccuacagcuggaccgaccacucccaacgggaacuugguggaugaaugugaugacgaccaggccaacugccacaguggaacaggugaugacuuccagcucacagguggcaccacugugcuggccacagaaaagcccacggucauagacagcaccauacaaucagguaucaaauaaaauacgaaaugugacagauu

SEQ ID NO: 185 - RNA, 2373 nt, Homo_Sapiens
gcaguuggugaaacuccucugucucccgcucaucuuuucauugcucguuccccuccuucccgcagacacccggaccuccccugggcgccagcuccgcggcuccaacggguccagaaacaagccggauuuuuuuuuuuucuuccuggaaauuggcuuugguguguguugcccuaccucccuccucccccucccacccacagcccccccccggccuuuuuuuuuuuuuuuuuuuuuuuugagacauggcccgggcaguggcuccuggaagaggaacaagugugggaaaagggagaggaagccggagcuaaaugacaggaugcaggcgacuugagacacaaaaagagaagcguuccucucggauccaggcauugccucgcugcuuucuuuucuccaagacgggcugaggauuguacagcucuaggcggaguuggggcucuucggaucgcuuagauucuccucuuugcugcauuuccccccacguccucguucucccgcgucugccugcggacccggagaagggagaauggagagggggcugccgcuccucugcgccgugcucgcccucguccucgccccggccggcgcuuuucgcaacgauaaauguggcgauacuauaaaaauugaaagccccggguaccuuacaucuccugguuauccucauucuuaucacccaagugaaaaaugcgaauggcugauucaggcuccggacccauaccagagaauuaugaucaacuucaacccucacuucgauuuggaggacagagacugcaaguaugacuacguggaagucuucgauggagaaaaugaaaauggacauuuuaggggaaaguucuguggaaagauagccccuccuccuguugugucuucagggccauuucuuuuuaucaaauuugucucugacuacgaaacacauggugcaggauuuuccauacguuaugaaauuuucaagagagguccugaauguucccagaacuacacaacaccuaguggagugauaaagucccccggauucccugaaaaauaucccaacagccuugaaugcacuuauauugucuuugcgccaaagaugucagagauuauccuggaauuugaaagcuuugaccuggagccugacucaaauccuccaggggggauguucugucgcuacgaccggcuagaaaucugggauggauucccugauguuggcccucacauugggcguuacuguggacagaaaacaccaggucgaauccgauccucaucgggcauucucuccaugguuuuuuacaccgacagcgcgauagcaaaagaagguuucucagcaaacuacagugucuugcagagcagugucucagaagauuucaaauguauggaagcucugggcauggaaucaggagaaauucauucugaccagaucacagcuucuucccaguauagcaccaacuggucugcagagcgcucccgccugaacuacccugagaauggguggacucccggagaggauuccuaccgagaguggauacagguagacuugggccuucugcgcuuugucacggcugucgggacacagggcgccauuucaaaagaaaccaagaagaaauauuaugucaagacuuacaagaucgacguuagcuccaacggggaagacuggaucaccauaaaagaaggaaacaaaccuguucucuuucagggaaacaccaaccccacagauguugugguugcaguauuccccaaaccacugauaacucgauuuguccgaaucaagccugcaacuugggaaacuggcauaucuaugagauuugaaguauacgguugcaagauaacagauuauccuugcucuggaauguuggguauggugucuggacuuauuucugacucccagaucacaucauccaaccaaggggacagaaacuggaugccugaaaacauccgccugguaaccagucgcucuggcugggcacuuccacccgcaccucauuccuacaucaaugaguggcuccaaauagaccugggggaggagaagaucgugaggggcaucaucauucagggugggaagcaccgagagaacaagguguucaugaggaaguucaagaucggguacagcaacaacggcucggacuggaagaugaucauggaugacagcaaacgcaaggcgaagucuuuugagggcaacaacaacuaugauacaccugagcugcggacuuuuccagcucucuccacgcgauucaucaggaucuaccccgagagagccacucauggcggacuggggcucagaauggagcugcugggcugugaaguggaagguggcaccacugugcuggccacagaaaagcccacggucauagacagcaccauacaaucagguaucaaauaaaauacgaaaugugacagauu

SEQ ID NO: 186 - RNA, 6671 nt, Homo_Sapiens
cagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagacccaccgugcggaggucguuugaauuccaaagaugcuggcuauaucaccucucccgguuacccccaggacuaccccucccaccagaacugcgaguggauuguuuacgcccccgaacccaaccagaagauuguccucaacuucaacccucacuuugaaaucgagaagcacgacugcaaguaugacuuuaucgagauucgggauggggacagugaauccgcagaccuccugggcaaacacugugggaacaucgccccgcccaccaucaucuccucgggcuccaugcucuacaucaaguucaccuccgacuacgcccggcagggggcaggcuucucucugcgcuacgagaucuucaagacaggcucugaagauugcucaaaaaacuucacaagccccaacgggaccaucgaaucuccuggguuuccugagaaguauccacacaacuuggacugcaccuuuaccauccuggccaaacccaagauggagaucauccugcaguuccugaucuuugaccuggagcaugacccuuugcaggugggagagggggacugcaaguacgauuggcuggacaucugggauggcauuccacauguuggcccccugauuggcaaguacugugggaccaaaacacccucugaacuucguucaucgacggggauccucucccugaccuuucacacggacauggcgguggccaaggauggcuucucugcgcguuacuaccugguccaccaagagccacuagagaacuuucagugcaauguuccucugggcauggagucuggccggauugcuaaugaacagaucagugccucaucuaccuacucugaugggagguggaccccucaacaaagccggcuccauggugaugacaauggcuggacccccaacuuggauuccaacaaggaguaucuccagguggaccugcgcuuuuuaaccaugcucacggccaucgcaacacagggagcgauuuccagggaaacacagaauggcuacuaugucaaauccuacaagcuggaagucagcacuaauggagaggacuggaugguguaccggcauggcaaaaaccacaagguauuucaagccaacaacgaugcaacugaggugguucugaacaagcuccacgcuccacugcugacaagguuuguuagaauccgcccucagaccuggcacucagguaucgcccuccggcuggagcucuucggcugccgggucacagaugcucccugcuccaacaugcuggggaugcucucaggccucauugcagacucccagaucuccgccucuuccacccaggaauaccucuggagccccagugcagcccgccuggucagcagccgcucgggcugguucccucgaaucccucaggcccagcccggugaggaguggcuucagguagaucugggaacacccaagacagugaaaggugucaucauccagggagcccgcggaggagacaguaucacugcuguggaagccagagcauuugugcgcaaguucaaagucuccuacagccuaaacggcaaggacugggaauacauucaggaccccaggacccagcagccaaagcuguucgaagggaacaugcacuaugacaccccugacauccgaagguuugaccccauuccggcacaguaugugcggguauacccggagagguggucgccggcggggauugggaugcggcuggaggugcugggcugugacuggacagacuccaagcccacgguagagacgcugggacccacugugaagagcgaagagacaaccacccccuaccccaccgaagaggaggccacagaguguggggagaacugcagcuuugaggaugacaaagauuugcagcucccuucgggauucaauugcaacuucgauuuccucgaggagcccugugguuggauguaugaccaugccaaguggcuccggaccaccugggccagcagcuccagcccaaacgaccggacguuuccagaugacaggaauuucuugcggcugcagagugacagccagagagagggccaguaugcccggcucaucagccccccuguccaccugccccgaagcccggugugcauggaguuccaguaccaggccacgggcggccgcgggguggcgcugcagguggugcgggaagccagccaggagagcaaguugcugugggucauccgugaggaccagggcggcgaguggaagcacgggcggaucauccugcccagcuacgacauggaguaccagauuguguucgagggagugauagggaaaggacguuccggagagauugccauugaugacauucggauaagcacugaugucccacuggagaacugcauggaacccaucucggcuuuugcaggugagaauuuuaaaguggacaucccagaaauacaugagagagaaggauaugaagaugaaauugaugaugaauacgagguggacuggagcaauucuucuucugcaaccucagggucuggcgcccccucgaccgacaaagaaaagagcuggcuguacacccuggaucccauccucaucaccaucaucgccaugagcucacugggcguccuccugggggccaccugugcaggccuccugcucuacugcaccuguuccuacucgggccugagcucccgaagcugcaccacacuggagaacuacaacuucgagcucuacgauggccuuaagcacaaggucaagaugaaccaccaaaagugcugcuccgaggcaugacggauugcaccugaauccuaucugacguuucauuccagcaagaggggcuggggaagauuacauuuuuuuuuccuuuggaaacugaaugccauaaucucgaucaaaccgauccagaauaccgaagguauggacaggacagaaaagcgagucgcaggaggaagggagaugcagccgcacaggggaugauuacccuccuaggaccgcgguggcuaagucauugcaggaacggggcuguguucucugcugggacaaaacaggagcucaucucuuuggggucacaguucuauuuuguuugugaguuuguauuauuauuauuauuauuauuauuauuauauuuuauuucuuuggucugugagcaacucaaagaggcagaagaggagaaugacuuuuccagaauagaaguggagcagugaucauuauucuccgcuuucucuuucuaaucaacacuugaaaagcaaagugucuuuucagccuuuccaucuuuacaaauaaaacucaaaaaagccguccagcuuaucccauccucugauugucuucugacuuaagggauuuacugugguguagguucugccagccaacccuacaagcugccauuuccaguccuagcauuuaaguaggauguuguugccuuuaacuuuucuuauccaggggaaaauugccauuuuagggucagcaugaacagcucuuucuuguaugcgauuuaaaacaaacuggaaaggaaacuucacacgucaaaauccauagaagcgccuggacgaggcuuaaagugcuuugugagugaauaggagccauucgcuaauucuagacccacagugucuggugguggggcuucccuuguggggcuucugguggugguuuugccuuuucuuuucccuccuccauguucuucuaaaacauauacauauauacauacacacauacacauauucuucaggucucuaagccccuggaagcagcauugugugauauucucagaggcaggggaaaauagagggaaaaauagagacuauugguauguucuccccaucagcgaguuauuguaacuggucaccacuggacgggaaggagaacagaggagagggaaagagaagcccaaccucugugaucauaugagggccaaggcugagcaguguagacagagacccuuugaaaugcauuugucucucaaauagacuaguaaacaccgacuucuccuuuggguuacaaacaccauuucaaccuuucgggagagucagagcuaggauguacaagaacugauucuaaccagaaguccgcaaguacuguggacaagaaugcuuaaccaugcugcuucagccuugagagaccuagguucuuacacauaugcacacacgcauacacacaugcacgcacacacacauacacacaugcacgcacgcacgcaugcacaccaauuuauguuuuuauuaagugccuugaaaaaaugaagaaaaauguauuuucccuuuauguaaaaauuagugaauaucuuaugaauuaaggcauuccucuuucccuaaccccgauggcuccauucccaaguaccccaacucacugcugauccuauuaaaggaaugaguccugcuacccgagugguagucauagcccuagaugacucucaacuacucuucaaagggaggcaucaggaauagaaugaaacugugugaaggauaagauuguucgcaucaagauccaaaucuugauuucauauuaacgccuaaggauugccugugugcuggaaauauauuugaaacucaaccaguaugcccagccuauugcauaucauugucagaccauuuuugcugcuguggucacccacgauuucauuugucuuauacccaggugaaaggggaagggugaaugggacuggcugguuccuuuaaauguuaacuuauggaaaugcuaguucaaaugguaaugucacaguguuuuguaugcagagagcaagaguucaaccaacagcuguuuauucaugugugugugucuuugcugcuuugaguucucuguaucuacuguguaugugaauggucaugugggacucaguggugguguugugacuuugaccuaggguccgagugucacagcugaucuuggcacucggcacucauuggcacagugguaguuagaggugaaaaguagagcugucaagcccaagggcuuagcuuuagggcuccuccugaguucggcccacaguagaagcaagauuuuaacuagccccuuuuccucuucacccucccaugaugcgcaguguucagaaagcugguaaguccuagggauuuccagaaguagccugcagaagaagguaaguuugaaagccacuccagggguccugaugcugucaugcucagugagccauuuuacaguucuccaaagucuagcccuguuucggaccugcacuucaccucuaaguuauguacaacucaaccugcaucccucuaaaaguccuauauccauauucaccauuggcuaauuugaggcccugagugggccuugaaugcuaaaaagaagcaggguacgcagggcuacauguagauaccacaccaaggcuggaggcuggucugucauaagacagaaagaaagacgcugggcccaauuuugacuuggccaggggacaccuugguguguuuguuaucuuuaucuguggguaggcuagcugacccaucuccuugagucauucccuuugggaaaccccacugccaguauugaucuccuuuuugccuuguacugaaugacacauuaccuccacacucucccggacuagguggucaacagggccacaggguugcuuucugucuuugguggggcaggggaguugacagggaugaggguccaaggaauaagcaugaaugacaagaaaacaagggaaagaguuaaccugucacauagcagguuaacuuuuucaggguuugcaguuagagguauucgaccauucacuggcugagccagaucacgggaacuugagagcuuuuacugugauucuucaauguaaaaaauaaacaacaaugucaaacuguguuuauaugauuuguauaaagccuuuuuaagauuacuauuuaaauaaacauuauaccagagauaaaaaaaaaa

SEQ ID NO: 187 - RNA, 6656 nt, Homo_Sapiens
cagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagacccaccgugcggaggucguuugaauuccaaagaugcuggcuauaucaccucucccgguuacccccaggacuaccccucccaccagaacugcgaguggauuguuuacgcccccgaacccaaccagaagauuguccucaacuucaacccucacuuugaaaucgagaagcacgacugcaaguaugacuuuaucgagauucgggauggggacagugaauccgcagaccuccugggcaaacacugugggaacaucgccccgcccaccaucaucuccucgggcuccaugcucuacaucaaguucaccuccgacuacgcccggcagggggcaggcuucucucugcgcuacgagaucuucaagacaggcucugaagauugcucaaaaaacuucacaagccccaacgggaccaucgaaucuccuggguuuccugagaaguauccacacaacuuggacugcaccuuuaccauccuggccaaacccaagauggagaucauccugcaguuccugaucuuugaccuggagcaugacccuuugcaggugggagagggggacugcaaguacgauuggcuggacaucugggauggcauuccacauguuggcccccugauuggcaaguacugugggaccaaaacacccucugaacuucguucaucgacggggauccucucccugaccuuucacacggacauggcgguggccaaggauggcuucucugcgcguuacuaccugguccaccaagagccacuagagaacuuucagugcaauguuccucugggcauggagucuggccggauugcuaaugaacagaucagugccucaucuaccuacucugaugggagguggaccccucaacaaagccggcuccauggugaugacaauggcuggacccccaacuuggauuccaacaaggaguaucuccagguggaccugcgcuuuuuaaccaugcucacggccaucgcaacacagggagcgauuuccagggaaacacagaauggcuacuaugucaaauccuacaagcuggaagucagcacuaauggagaggacuggaugguguaccggcauggcaaaaaccacaagguauuucaagccaacaacgaugcaacugaggugguucugaacaagcuccacgcuccacugcugacaagguuuguuagaauccgcccucagaccuggcacucagguaucgcccuccggcuggagcucuucggcugccgggucacagaugcucccugcuccaacaugcuggggaugcucucaggccucauugcagacucccagaucuccgccucuuccacccaggaauaccucuggagccccagugcagcccgccuggucagcagccgcucgggcugguucccucgaaucccucaggcccagcccggugaggaguggcuucagguagaucugggaacacccaagacagugaaaggugucaucauccagggagcccgcggaggagacaguaucacugcuguggaagccagagcauuugugcgcaaguucaaagucuccuacagccuaaacggcaaggacugggaauacauucaggaccccaggacccagcagccaaagcuguucgaagggaacaugcacuaugacaccccugacauccgaagguuugaccccauuccggcacaguaugugcggguauacccggagagguggucgccggcggggauugggaugcggcuggaggugcugggcugugacuggacagacuccaagcccacgguagagacgcugggacccacugugaagagcgaagagacaaccacccccuaccccaccgaagaggaggccacagaguguggggagaacugcagcuuugaggaugacaaagauuugcagcucccuucgggauucaauugcaacuucgauuuccucgaggagcccugugguuggauguaugaccaugccaaguggcuccggaccaccugggccagcagcuccagcccaaacgaccggacguuuccagaugacaggaauuucuugcggcugcagagugacagccagagagagggccaguaugcccggcucaucagccccccuguccaccugccccgaagcccggugugcauggaguuccaguaccaggccacgggcggccgcgggguggcgcugcagguggugcgggaagccagccaggagagcaaguugcugugggucauccgugaggaccagggcggcgaguggaagcacgggcggaucauccugcccagcuacgacauggaguaccagauuguguucgagggagugauagggaaaggacguuccggagagauugccauugaugacauucggauaagcacugaugucccacuggagaacugcauggaacccaucucggcuuuugcaguggacaucccagaaauacaugagagagaaggauaugaagaugaaauugaugaugaauacgagguggacuggagcaauucuucuucugcaaccucagggucuggcgcccccucgaccgacaaagaaaagagcuggcuguacacccuggaucccauccucaucaccaucaucgccaugagcucacugggcguccuccugggggccaccugugcaggccuccugcucuacugcaccuguuccuacucgggccugagcucccgaagcugcaccacacuggagaacuacaacuucgagcucuacgauggccuuaagcacaaggucaagaugaaccaccaaaagugcugcuccgaggcaugacggauugcaccugaauccuaucugacguuucauuccagcaagaggggcuggggaagauuacauuuuuuuuuccuuuggaaacugaaugccauaaucucgaucaaaccgauccagaauaccgaagguauggacaggacagaaaagcgagucgcaggaggaagggagaugcagccgcacaggggaugauuacccuccuaggaccgcgguggcuaagucauugcaggaacggggcuguguucucugcugggacaaaacaggagcucaucucuuuggggucacaguucuauuuuguuugugaguuuguauuauuauuauuauuauuauuauuauuauauuuuauuucuuuggucugugagcaacucaaagaggcagaagaggagaaugacuuuuccagaauagaaguggagcagugaucauuauucuccgcuuucucuuucuaaucaacacuugaaaagcaaagugucuuuucagccuuuccaucuuuacaaauaaaacucaaaaaagccguccagcuuaucccauccucugauugucuucugacuuaagggauuuacugugguguagguucugccagccaacccuacaagcugccauuuccaguccuagcauuuaaguaggauguuguugccuuuaacuuuucuuauccaggggaaaauugccauuuuagggucagcaugaacagcucuuucuuguaugcgauuuaaaacaaacuggaaaggaaacuucacacgucaaaauccauagaagcgccuggacgaggcuuaaagugcuuugugagugaauaggagccauucgcuaauucuagacccacagugucuggugguggggcuucccuuguggggcuucugguggugguuuugccuuuucuuuucccuccuccauguucuucuaaaacauauacauauauacauacacacauacacauauucuucaggucucuaagccccuggaagcagcauugugugauauucucagaggcaggggaaaauagagggaaaaauagagacuauugguauguucuccccaucagcgaguuauuguaacuggucaccacuggacgggaaggagaacagaggagagggaaagagaagcccaaccucugugaucauaugagggccaaggcugagcaguguagacagagacccuuugaaaugcauuugucucucaaauagacuaguaaacaccgacuucuccuuuggguuacaaacaccauuucaaccuuucgggagagucagagcuaggauguacaagaacugauucuaaccagaaguccgcaaguacuguggacaagaaugcuuaaccaugcugcuucagccuugagagaccuagguucuuacacauaugcacacacgcauacacacaugcacgcacacacacauacacacaugcacgcacgcacgcaugcacaccaauuuauguuuuuauuaagugccuugaaaaaaugaagaaaaauguauuuucccuuuauguaaaaauuagugaauaucuuaugaauuaaggcauuccucuuucccuaaccccgauggcuccauucccaaguaccccaacucacugcugauccuauuaaaggaaugaguccugcuacccgagugguagucauagcccuagaugacucucaacuacucuucaaagggaggcaucaggaauagaaugaaacugugugaaggauaagauuguucgcaucaagauccaaaucuugauuucauauuaacgccuaaggauugccugugugcuggaaauauauuugaaacucaaccaguaugcccagccuauugcauaucauugucagaccauuuuugcugcuguggucacccacgauuucauuugucuuauacccaggugaaaggggaagggugaaugggacuggcugguuccuuuaaauguuaacuuauggaaaugcuaguucaaaugguaaugucacaguguuuuguaugcagagagcaagaguucaaccaacagcuguuuauucaugugugugugucuuugcugcuuugaguucucuguaucuacuguguaugugaauggucaugugggacucaguggugguguugugacuuugaccuaggguccgagugucacagcugaucuuggcacucggcacucauuggcacagugguaguuagaggugaaaaguagagcugucaagcccaagggcuuagcuuuagggcuccuccugaguucggcccacaguagaagcaagauuuuaacuagccccuuuuccucuucacccucccaugaugcgcaguguucagaaagcugguaaguccuagggauuuccagaaguagccugcagaagaagguaaguuugaaagccacuccagggguccugaugcugucaugcucagugagccauuuuacaguucuccaaagucuagcccuguuucggaccugcacuucaccucuaaguuauguacaacucaaccugcaucccucuaaaaguccuauauccauauucaccauuggcuaauuugaggcccugagugggccuugaaugcuaaaaagaagcaggguacgcagggcuacauguagauaccacaccaaggcuggaggcuggucugucauaagacagaaagaaagacgcugggcccaauuuugacuuggccaggggacaccuugguguguuuguuaucuuuaucuguggguaggcuagcugacccaucuccuugagucauucccuuugggaaaccccacugccaguauugaucuccuuuuugccuuguacugaaugacacauuaccuccacacucucccggacuagguggucaacagggccacaggguugcuuucugucuuugguggggcaggggaguugacagggaugaggguccaaggaauaagcaugaaugacaagaaaacaagggaaagaguuaaccugucacauagcagguuaacuuuuucaggguuugcaguuagagguauucgaccauucacuggcugagccagaucacgggaacuugagagcuuuuacugugauucuucaauguaaaaaauaaacaacaaugucaaacuguguuuauaugauuuguauaaagccuuuuuaagauuacuauuuaaauaaacauuauaccagagauaaaaaaaaaa

SEQ ID NO: 188 - RNA, 6605 nt, Homo_Sapiens
cagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagacccaccgugcggaggucguuugaauuccaaagaugcuggcuauaucaccucucccgguuacccccaggacuaccccucccaccagaacugcgaguggauuguuuacgcccccgaacccaaccagaagauuguccucaacuucaacccucacuuugaaaucgagaagcacgacugcaaguaugacuuuaucgagauucgggauggggacagugaauccgcagaccuccugggcaaacacugugggaacaucgccccgcccaccaucaucuccucgggcuccaugcucuacaucaaguucaccuccgacuacgcccggcagggggcaggcuucucucugcgcuacgagaucuucaagacaggcucugaagauugcucaaaaaacuucacaagccccaacgggaccaucgaaucuccuggguuuccugagaaguauccacacaacuuggacugcaccuuuaccauccuggccaaacccaagauggagaucauccugcaguuccugaucuuugaccuggagcaugacccuuugcaggugggagagggggacugcaaguacgauuggcuggacaucugggauggcauuccacauguuggcccccugauuggcaaguacugugggaccaaaacacccucugaacuucguucaucgacggggauccucucccugaccuuucacacggacauggcgguggccaaggauggcuucucugcgcguuacuaccugguccaccaagagccacuagagaacuuucagugcaauguuccucugggcauggagucuggccggauugcuaaugaacagaucagugccucaucuaccuacucugaugggagguggaccccucaacaaagccggcuccauggugaugacaauggcuggacccccaacuuggauuccaacaaggaguaucuccagguggaccugcgcuuuuuaaccaugcucacggccaucgcaacacagggagcgauuuccagggaaacacagaauggcuacuaugucaaauccuacaagcuggaagucagcacuaauggagaggacuggaugguguaccggcauggcaaaaaccacaagguauuucaagccaacaacgaugcaacugaggugguucugaacaagcuccacgcuccacugcugacaagguuuguuagaauccgcccucagaccuggcacucagguaucgcccuccggcuggagcucuucggcugccgggucacagaugcucccugcuccaacaugcuggggaugcucucaggccucauugcagacucccagaucuccgccucuuccacccaggaauaccucuggagccccagugcagcccgccuggucagcagccgcucgggcugguucccucgaaucccucaggcccagcccggugaggaguggcuucagguagaucugggaacacccaagacagugaaaggugucaucauccagggagcccgcggaggagacaguaucacugcuguggaagccagagcauuugugcgcaaguucaaagucuccuacagccuaaacggcaaggacugggaauacauucaggaccccaggacccagcagccaaagcuguucgaagggaacaugcacuaugacaccccugacauccgaagguuugaccccauuccggcacaguaugugcggguauacccggagagguggucgccggcggggauugggaugcggcuggaggugcugggcugugacuggacagacuccaagcccacgguagagacgcugggacccacugugaagagcgaagagacaaccacccccuaccccaccgaagaggaggccacagaguguggggagaacugcagcuuugaggaugacaaagauuugcagcucccuucgggauucaauugcaacuucgauuuccucgaggagcccugugguuggauguaugaccaugccaaguggcuccggaccaccugggccagcagcuccagcccaaacgaccggacguuuccagaugacaggaauuucuugcggcugcagagugacagccagagagagggccaguaugcccggcucaucagccccccuguccaccugccccgaagcccggugugcauggaguuccaguaccaggccacgggcggccgcgggguggcgcugcagguggugcgggaagccagccaggagagcaaguugcugugggucauccgugaggaccagggcggcgaguggaagcacgggcggaucauccugcccagcuacgacauggaguaccagauuguguucgagggagugauagggaaaggacguuccggagagauugccauugaugacauucggauaagcacugaugucccacuggagaacugcauggaacccaucucggcuuuugcagaugaauacgagguggacuggagcaauucuucuucugcaaccucagggucuggcgcccccucgaccgacaaagaaaagagcuggcuguacacccuggaucccauccucaucaccaucaucgccaugagcucacugggcguccuccugggggccaccugugcaggccuccugcucuacugcaccuguuccuacucgggccugagcucccgaagcugcaccacacuggagaacuacaacuucgagcucuacgauggccuuaagcacaaggucaagaugaaccaccaaaagugcugcuccgaggcaugacggauugcaccugaauccuaucugacguuucauuccagcaagaggggcuggggaagauuacauuuuuuuuuccuuuggaaacugaaugccauaaucucgaucaaaccgauccagaauaccgaagguauggacaggacagaaaagcgagucgcaggaggaagggagaugcagccgcacaggggaugauuacccuccuaggaccgcgguggcuaagucauugcaggaacggggcuguguucucugcugggacaaaacaggagcucaucucuuuggggucacaguucuauuuuguuugugaguuuguauuauuauuauuauuauuauuauuauuauauuuuauuucuuuggucugugagcaacucaaagaggcagaagaggagaaugacuuuuccagaauagaaguggagcagugaucauuauucuccgcuuucucuuucuaaucaacacuugaaaagcaaagugucuuuucagccuuuccaucuuuacaaauaaaacucaaaaaagccguccagcuuaucccauccucugauugucuucugacuuaagggauuuacugugguguagguucugccagccaacccuacaagcugccauuuccaguccuagcauuuaaguaggauguuguugccuuuaacuuuucuuauccaggggaaaauugccauuuuagggucagcaugaacagcucuuucuuguaugcgauuuaaaacaaacuggaaaggaaacuucacacgucaaaauccauagaagcgccuggacgaggcuuaaagugcuuugugagugaauaggagccauucgcuaauucuagacccacagugucuggugguggggcuucccuuguggggcuucugguggugguuuugccuuuucuuuucccuccuccauguucuucuaaaacauauacauauauacauacacacauacacauauucuucaggucucuaagccccuggaagcagcauugugugauauucucagaggcaggggaaaauagagggaaaaauagagacuauugguauguucuccccaucagcgaguuauuguaacuggucaccacuggacgggaaggagaacagaggagagggaaagagaagcccaaccucugugaucauaugagggccaaggcugagcaguguagacagagacccuuugaaaugcauuugucucucaaauagacuaguaaacaccgacuucuccuuuggguuacaaacaccauuucaaccuuucgggagagucagagcuaggauguacaagaacugauucuaaccagaaguccgcaaguacuguggacaagaaugcuuaaccaugcugcuucagccuugagagaccuagguucuuacacauaugcacacacgcauacacacaugcacgcacacacacauacacacaugcacgcacgcacgcaugcacaccaauuuauguuuuuauuaagugccuugaaaaaaugaagaaaaauguauuuucccuuuauguaaaaauuagugaauaucuuaugaauuaaggcauuccucuuucccuaaccccgauggcuccauucccaaguaccccaacucacugcugauccuauuaaaggaaugaguccugcuacccgagugguagucauagcccuagaugacucucaacuacucuucaaagggaggcaucaggaauagaaugaaacugugugaaggauaagauuguucgcaucaagauccaaaucuugauuucauauuaacgccuaaggauugccugugugcuggaaauauauuugaaacucaaccaguaugcccagccuauugcauaucauugucagaccauuuuugcugcuguggucacccacgauuucauuugucuuauacccaggugaaaggggaagggugaaugggacuggcugguuccuuuaaauguuaacuuauggaaaugcuaguucaaaugguaaugucacaguguuuuguaugcagagagcaagaguucaaccaacagcuguuuauucaugugugugugucuuugcugcuuugaguucucuguaucuacuguguaugugaauggucaugugggacucaguggugguguugugacuuugaccuaggguccgagugucacagcugaucuuggcacucggcacucauuggcacagugguaguuagaggugaaaaguagagcugucaagcccaagggcuuagcuuuagggcuccuccugaguucggcccacaguagaagcaagauuuuaacuagccccuuuuccucuucacccucccaugaugcgcaguguucagaaagcugguaaguccuagggauuuccagaaguagccugcagaagaagguaaguuugaaagccacuccagggguccugaugcugucaugcucagugagccauuuuacaguucuccaaagucuagcccuguuucggaccugcacuucaccucuaaguuauguacaacucaaccugcaucccucuaaaaguccuauauccauauucaccauuggcuaauuugaggcccugagugggccuugaaugcuaaaaagaagcaggguacgcagggcuacauguagauaccacaccaaggcuggaggcuggucugucauaagacagaaagaaagacgcugggcccaauuuugacuuggccaggggacaccuugguguguuuguuaucuuuaucuguggguaggcuagcugacccaucuccuugagucauucccuuugggaaaccccacugccaguauugaucuccuuuuugccuuguacugaaugacacauuaccuccacacucucccggacuagguggucaacagggccacaggguugcuuucugucuuugguggggcaggggaguugacagggaugaggguccaaggaauaagcaugaaugacaagaaaacaagggaaagaguuaaccugucacauagcagguuaacuuuuucaggguuugcaguuagagguauucgaccauucacuggcugagccagaucacgggaacuugagagcuuuuacugugauucuucaauguaaaaaauaaacaacaaugucaaacuguguuuauaugauuuguauaaagccuuuuuaagauuacuauuuaaauaaacauuauaccagagauaaaaaaaaaa

SEQ ID NO: 189 - RNA, 4163 nt, Homo_Sapiens
cagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagacccaccgugcggaggucguuugaauuccaaagaugcuggcuauaucaccucucccgguuacccccaggacuaccccucccaccagaacugcgaguggauuguuuacgcccccgaacccaaccagaagauuguccucaacuucaacccucacuuugaaaucgagaagcacgacugcaaguaugacuuuaucgagauucgggauggggacagugaauccgcagaccuccugggcaaacacugugggaacaucgccccgcccaccaucaucuccucgggcuccaugcucuacaucaaguucaccuccgacuacgcccggcagggggcaggcuucucucugcgcuacgagaucuucaagacaggcucugaagauugcucaaaaaacuucacaagccccaacgggaccaucgaaucuccuggguuuccugagaaguauccacacaacuuggacugcaccuuuaccauccuggccaaacccaagauggagaucauccugcaguuccugaucuuugaccuggagcaugacccuuugcaggugggagagggggacugcaaguacgauuggcuggacaucugggauggcauuccacauguuggcccccugauuggcaaguacugugggaccaaaacacccucugaacuucguucaucgacggggauccucucccugaccuuucacacggacauggcgguggccaaggauggcuucucugcgcguuacuaccugguccaccaagagccacuagagaacuuucagugcaauguuccucugggcauggagucuggccggauugcuaaugaacagaucagugccucaucuaccuacucugaugggagguggaccccucaacaaagccggcuccauggugaugacaauggcuggacccccaacuuggauuccaacaaggaguaucuccagguggaccugcgcuuuuuaaccaugcucacggccaucgcaacacagggagcgauuuccagggaaacacagaauggcuacuaugucaaauccuacaagcuggaagucagcacuaauggagaggacuggaugguguaccggcauggcaaaaaccacaagguauuucaagccaacaacgaugcaacugaggugguucugaacaagcuccacgcuccacugcugacaagguuuguuagaauccgcccucagaccuggcacucagguaucgcccuccggcuggagcucuucggcugccgggucacagaugcucccugcuccaacaugcuggggaugcucucaggccucauugcagacucccagaucuccgccucuuccacccaggaauaccucuggagccccagugcagcccgccuggucagcagccgcucgggcugguucccucgaaucccucaggcccagcccggugaggaguggcuucagguagaucugggaacacccaagacagugaaaggugucaucauccagggagcccgcggaggagacaguaucacugcuguggaagccagagcauuugugcgcaaguucaaagucuccuacagccuaaacggcaaggacugggaauacauucaggaccccaggacccagcagccaaagcuguucgaagggaacaugcacuaugacaccccugacauccgaagguuugaccccauuccggcacaguaugugcggguauacccggagagguggucgccggcggggauugggaugcggcuggaggugcugggcugugacuggacagacuccaagcccacgguagagacgcugggacccacugugaagagcgaagagacaaccacccccuaccccaccgaagaggaggccacagaguguggggagaacugcagcuuugaggaugacaaagauuugcagcucccuucgggauucaauugcaacuucgauuuccucgaggagcccugugguuggauguaugaccaugccaaguggcuccggaccaccugggccagcagcuccagcccaaacgaccggacguuuccagaugacaggaauuucuugcggcugcagagugacagccagagagagggccaguaugcccggcucaucagccccccuguccaccugccccgaagcccggugugcauggaguuccaguaccaggccacgggcggccgcgggguggcgcugcagguggugcgggaagccagccaggagagcaaguugcugugggucauccgugaggaccagggcggcgaguggaagcacgggcggaucauccugcccagcuacgacauggaguaccagauuguguucgagggagugauagggaaaggacguuccggagagauugccauugaugacauucggauaagcacugaugucccacuggagaacugcauggaacccaucucggcuuuugcaggugagaauuuuaaagggggcacccuccugccagggaccgagcccacaguggacacggugcccaugcagcccaucccagccuacugguauuacguaauggccgccgggggcgccgugcuggugcuggucuccgucgcgcuggcccuggugcuccacuaccaccgguuccgcuaugcggccaagaagaccgaucacuccaucaccuacaaaaccucccacuacaccaacggggccccucuggcgguggagcccacccuaaccauuaagcuagagcaagaccguggcucgcacugcugagggccgaagcaagaacagcacccaaaacaaacgagaaagacugcaaacauguugccucgauuuugcacuuuuuucuccucgccuaguuucugugugaacucucagacaucucuuucccggauccccaacccugagcacucuuaucaaucccaaccauccuccuuggguucauuuugguuucugguuuuucuuuuuccuuuuuguugauuccaaaccaacaaacccaacucuaaugcugcaucuuggacuauccgaagagauccacccccaagcacuccacaacucaaggcucagcugguuuuguuccagagacugguucgcuuguuuuuuccccuugccuuaucccauaccuccucucagugggcagucugccaggagacgugaggggaagccuggaucuguguguauguacauaguagacaugugugugugugaauagcucucugugugugggugugugagagagcggcugguucauuguguguguguuugggcgaggggugaguguucagagagggccccuuuaacucuuauguuacuucuccugggguacauuuuacaagaaaauaauauacuguacaaguuuuguuuacuuggagaagagauugaagcuuuuuguugccuuaucuaaaaaaaaaaaaaaaaaaaaaa

SEQ ID NO: 190 - RNA, 4148 nt, Homo_Sapiens
cagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagacccaccgugcggaggucguuugaauuccaaagaugcuggcuauaucaccucucccgguuacccccaggacuaccccucccaccagaacugcgaguggauuguuuacgcccccgaacccaaccagaagauuguccucaacuucaacccucacuuugaaaucgagaagcacgacugcaaguaugacuuuaucgagauucgggauggggacagugaauccgcagaccuccugggcaaacacugugggaacaucgccccgcccaccaucaucuccucgggcuccaugcucuacaucaaguucaccuccgacuacgcccggcagggggcaggcuucucucugcgcuacgagaucuucaagacaggcucugaagauugcucaaaaaacuucacaagccccaacgggaccaucgaaucuccuggguuuccugagaaguauccacacaacuuggacugcaccuuuaccauccuggccaaacccaagauggagaucauccugcaguuccugaucuuugaccuggagcaugacccuuugcaggugggagagggggacugcaaguacgauuggcuggacaucugggauggcauuccacauguuggcccccugauuggcaaguacugugggaccaaaacacccucugaacuucguucaucgacggggauccucucccugaccuuucacacggacauggcgguggccaaggauggcuucucugcgcguuacuaccugguccaccaagagccacuagagaacuuucagugcaauguuccucugggcauggagucuggccggauugcuaaugaacagaucagugccucaucuaccuacucugaugggagguggaccccucaacaaagccggcuccauggugaugacaauggcuggacccccaacuuggauuccaacaaggaguaucuccagguggaccugcgcuuuuuaaccaugcucacggccaucgcaacacagggagcgauuuccagggaaacacagaauggcuacuaugucaaauccuacaagcuggaagucagcacuaauggagaggacuggaugguguaccggcauggcaaaaaccacaagguauuucaagccaacaacgaugcaacugaggugguucugaacaagcuccacgcuccacugcugacaagguuuguuagaauccgcccucagaccuggcacucagguaucgcccuccggcuggagcucuucggcugccgggucacagaugcucccugcuccaacaugcuggggaugcucucaggccucauugcagacucccagaucuccgccucuuccacccaggaauaccucuggagccccagugcagcccgccuggucagcagccgcucgggcugguucccucgaaucccucaggcccagcccggugaggaguggcuucagguagaucugggaacacccaagacagugaaaggugucaucauccagggagcccgcggaggagacaguaucacugcuguggaagccagagcauuugugcgcaaguucaaagucuccuacagccuaaacggcaaggacugggaauacauucaggaccccaggacccagcagccaaagcuguucgaagggaacaugcacuaugacaccccugacauccgaagguuugaccccauuccggcacaguaugugcggguauacccggagagguggucgccggcggggauugggaugcggcuggaggugcugggcugugacuggacagacuccaagcccacgguagagacgcugggacccacugugaagagcgaagagacaaccacccccuaccccaccgaagaggaggccacagaguguggggagaacugcagcuuugaggaugacaaagauuugcagcucccuucgggauucaauugcaacuucgauuuccucgaggagcccugugguuggauguaugaccaugccaaguggcuccggaccaccugggccagcagcuccagcccaaacgaccggacguuuccagaugacaggaauuucuugcggcugcagagugacagccagagagagggccaguaugcccggcucaucagccccccuguccaccugccccgaagcccggugugcauggaguuccaguaccaggccacgggcggccgcgggguggcgcugcagguggugcgggaagccagccaggagagcaaguugcugugggucauccgugaggaccagggcggcgaguggaagcacgggcggaucauccugcccagcuacgacauggaguaccagauuguguucgagggagugauagggaaaggacguuccggagagauugccauugaugacauucggauaagcacugaugucccacuggagaacugcauggaacccaucucggcuuuugcagggggcacccuccugccagggaccgagcccacaguggacacggugcccaugcagcccaucccagccuacugguauuacguaauggccgccgggggcgccgugcuggugcuggucuccgucgcgcuggcccuggugcuccacuaccaccgguuccgcuaugcggccaagaagaccgaucacuccaucaccuacaaaaccucccacuacaccaacggggccccucuggcgguggagcccacccuaaccauuaagcuagagcaagaccguggcucgcacugcugagggccgaagcaagaacagcacccaaaacaaacgagaaagacugcaaacauguugccucgauuuugcacuuuuuucuccucgccuaguuucugugugaacucucagacaucucuuucccggauccccaacccugagcacucuuaucaaucccaaccauccuccuuggguucauuuugguuucugguuuuucuuuuuccuuuuuguugauuccaaaccaacaaacccaacucuaaugcugcaucuuggacuauccgaagagauccacccccaagcacuccacaacucaaggcucagcugguuuuguuccagagacugguucgcuuguuuuuuccccuugccuuaucccauaccuccucucagugggcagucugccaggagacgugaggggaagccuggaucuguguguauguacauaguagacaugugugugugugaauagcucucugugugugggugugugagagagcggcugguucauuguguguguguuugggcgaggggugaguguucagagagggccccuuuaacucuuauguuacuucuccugggguacauuuuacaagaaaauaauauacuguacaaguuuuguuuacuuggagaagagauugaagcuuuuuguugccuuaucuaaaaaaaaaaaaaaaaaaaaaa

SEQ ID NO: 191 - RNA, 2601 nt, Homo_Sapiens
cagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagacccaccgugcggaggucguuugaauuccaaagaugcuggcuauaucaccucucccgguuacccccaggacuaccccucccaccagaacugcgaguggauuguuuacgcccccgaacccaaccagaagauuguccucaacuucaacccucacuuugaaaucgagaagcacgacugcaaguaugacuuuaucgagauucgggauggggacagugaauccgcagaccuccugggcaaacacugugggaacaucgccccgcccaccaucaucuccucgggcuccaugcucuacaucaaguucaccuccgacuacgcccggcagggggcaggcuucucucugcgcuacgagaucuucaagacaggcucugaagauugcucaaaaaacuucacaagccccaacgggaccaucgaaucuccuggguuuccugagaaguauccacacaacuuggacugcaccuuuaccauccuggccaaacccaagauggagaucauccugcaguuccugaucuuugaccuggagcaugacccuuugcaggugggagagggggacugcaaguacgauuggcuggacaucugggauggcauuccacauguuggcccccugauuggcaaguacugugggaccaaaacacccucugaacuucguucaucgacggggauccucucccugaccuuucacacggacauggcgguggccaaggauggcuucucugcgcguuacuaccugguccaccaagagccacuagagaacuuucagugcaauguuccucugggcauggagucuggccggauugcuaaugaacagaucagugccucaucuaccuacucugaugggagguggaccccucaacaaagccggcuccauggugaugacaauggcuggacccccaacuuggauuccaacaaggaguaucuccagguggaccugcgcuuuuuaaccaugcucacggccaucgcaacacagggagcgauuuccagggaaacacagaauggcuacuaugucaaauccuacaagcuggaagucagcacuaauggagaggacuggaugguguaccggcauggcaaaaaccacaagguauuucaagccaacaacgaugcaacugaggugguucugaacaagcuccacgcuccacugcugacaagguuuguuagaauccgcccucagaccuggcacucagguaucgcccuccggcuggagcucuucggcugccgggucacagaugcucccugcuccaacaugcuggggaugcucucaggccucauugcagacucccagaucuccgccucuuccacccaggaauaccucuggagccccagugcagcccgccuggucagcagccgcucgggcugguucccucgaaucccucaggcccagcccggugaggaguggcuucagguagaucugggaacacccaagacagugaaaggugucaucauccagggagcccgcggaggagacaguaucacugcuguggaagccagagcauuugugcgcaaguucaaagucuccuacagccuaaacggcaaggacugggaauacauucaggaccccaggacccagcagccaaagguaggcuguucuuggaggccucuguaacguuacccucaacagggaggcuaagugugguacagggaguugagacugaugaugucccaucuaaacagucgucauccaacuccugaaauccaauaaaacaaauaucguuugagagauuaaaaaaaaaaaaaaaaaaaaaaaa

SEQ ID NO: 192 - RNA, 9071 nt, Homo_Sapiens
augccgcugccaccgcggagccugcaggugcuccugcugcugcugcuguugcugcugcugcugccgggcaugugggcugaggcaggcuugcccagggcaggcggggguucacagccccccuuccgcaccuucucggccagcgacuggggccucacccaccuaguggugcaugagcagacaggcgagguguaugugggcgcagugaaccgcaucuauaagcugucggggaaccugacacugcugcgggcccacgucacgggcccuguggaggacaacgagaagugcuacccgccgcccagcgugcaguccugcccccacggccugggcaguacugacaacgucaacaagcugcugcugcuggacuaugccgcuaaccgccugcuggccuguggcagcgccucccagggcaucugccaguuccugcgucuggacgaucucuucaaacugggugagccacaccaccguaaggagcacuaccuguccagcgugcaggaggcaggcagcauggcgggcgugcucauugccgggccaccgggccagggccaggccaagcucuucgugggcacacccaucgauggcaaguccgaguacuuccccacacuguccagccgucggcucauggccaacgaggaggaugccgacauguucggcuucguguaccaggaugaguuugugucaucacagcucaagaucccuucggacacgcuguccaaguucccggccuuugacaucuacuauguguacagcuuccgcagcgagcaguuugucuacuaccucacgcugcagcuagacacacagcugaccucgccugaugccgccggcgagcacuucuucacguccaagaucgugcggcucuguguggacgaccccaaauucuacucguacguugaguuccccauuggcugcgagcaggcggguguggaguaccgccuggugcaggaugccuaccugagccggcccggccgugcccuggcccaccagcugggccuggcugaggacgaggacgugcuguucacuguguucgcccagggccagaagaaccgcgugaagccaccaaaggagucagcacugugccuguucacgcucagggccaucaaggagaagauuaaggagcgcauccaguccugcuaccguggugagggcaagcucucccugccguggcugcucaacaaggagcugggcugcaucaacucgccccugcagaucgaugacgacuucugcgggcaggacuucaaccagccccuggggggcacagucaccauugaggggacgccccuguucguggacaaggaugauggccugaccgccguggcugccuaugacuaucggggccgcacugugguauucgccggcacgcgaaguggccgcauccgcaagauccugguggaccucucaaaccccgguggccggccugcccuggccuacgagagcgucguggcccaggagggcagccccauccugcgagaccucguccucagccccaaccaccaguaccucuacgccaugaccgagaagcaggugacgcgggugccuguggagagcugugugcaguacacguccugugagcugugucuggggucacgggacccccacuguggcugguguguccugcacagcaucugcucgcggcgggacgccugugagcgagcagacgagccccagcgcuuugcugcggaccugcugcagugugugcagcugacugugcagccccgcaaugugucugucaccaugucccaggucccacuugugcugcaggccuggaacgugccugaccucucagcuggcgucaacugcuccuucgaggacuucacggaaucugagagcguccuggaggauggccggauccacugccgcucacccuccgcccgggagguggcgcccaucacgcggggccagggagaccagcggguggugaaacucuaccuaaaguccaaggagacagggaagaaguuugcgucuguggacuucgucuucuacaacugcagcguccaccaguccugccuguccugugucaacggcuccuuucccugccacuggugcaaauaccgccacgugugcacacacaacguggcugacugcgccuuccuggagggccgugucaacgugucugaggacugcccacagauccugcccuccacgcagaucuacgugccagugggagugguaaaacccaucacccuggccgcacggaaccugccacagccacagucaggccagcguggauaugagugccucuuccacaucccgggcagcccggcccgugucaccgcccugcgcuucaacagcuccagccugcagugccagaauuccucguacuccuacgaggggaacgaugucagcgaccugccagugaaccugucagucguguggaacggcaacuuugucauugacaacccacagaacauccaggcgcaccucuacaagugcccggcccugcgcgagagcugcggccucugccucaaggccgacccgcgcuucgagugcggauggugcguggccgagcgccgcugcucccugcgacaccacugcgcugccgacacaccugcaucguggaugcacgcgcgucacggcagcagucgcugcaccgaccccaagauccucaagcugucccccgagacgggcccgaggcagggcggcacgcggcucacuaucacaggcgagaaccugggccugcgauucgaagacgugcgucugggcgugcgcgugggcaaggugcugugcagcccuguggagagcgaguacaucagugcggagcagaucgucugugagaucggggacgccagcuccgugcgugcccaugacgcccugguggaggugugugugcgggacugcucaccacacuaccgcgcccugucacccaagcgcuucaccuucgugacaccaaccuucuaccgugugagccccucccgugggccucugucagggggcaccuggauuggcaucgagggaagccaccugaacgcaggcagugauguggcugugucggucgguggccggcccugcuccuucuccuggaggaacucccgugagauccggugccugacaccccccgggcagagcccuggcagcgcucccaucaucaucaacaucaaccgcgcccagcucaccaacccugaggugaaguacaacuacaccgaggaccccaccauccugaggaucgaccccgaguggagcaucaacagcggugggacccuccugacggucacaggcaccaaccuggccacuguccgugaaccccgaauccgggccaaguauggaggcauugagagggagaacggcugccugguguacaaugacaccaccaugguaugccgcgccccgucuguggccaacccugugcgcagcccaccagagcugggggagcggccggaugagcugggcuucgucauggacaacgugcgcucccugcuugugcucaacuccaccuccuuccucuacuacccugaccccguacuggagccacucagccccacuggccugcuggagcugaagcccagcuccccacucauccucaagggccggaaccucuugccaccugcacccggcaacucccgacucaacuacacggugcucaucggcuccacacccuguacccucaccgugucggagacgcaacugcugugcgaggcgcccaaccucacugggcagcacaaggucacggugcgggcagguggcuucgaguucucgccagggacacugcagguguacucggacagccugcugacgcugccugccauugugggcauuggcggaggcgggggucuccugcugcuggucaucguggcugugcucaucgccuacaagcgcaagucacgagaugcugaccgcacacucaagcggcugcagcuccagauggacaaccuggagucccgcguggcccucgaaugcaaggaagccuuugcagagcugcagacagacauccacgagcugaccaaugaccuggacggugccggcauccccuuccuugacuaccggacauaugccaugcgggugcucuuuccugggaucgaggaccacccugugcucaaggagauggaggugcaggccaauguggagaagucgcugacacuguucgggcagcugcugaccaagaagcacuuccugcugaccuucauccgcacgcuggaggcacagcgcagcuucuccaugcgcgaccgcgggaauguggccucgcucaucaugacggcccugcagggcgagauggaauacgccacaggcgugcucaagcagcugcuuuccgaccucaucgagaagaaccuggagagcaagaaccaccccaagcugcuacugcgccggacugagucgguggcagagaagaugcuaacuaacugguucaccuuccucuuguauaaguuccucaaggagugcgcuggggagccgcuguucaugcuguacugcgccaucaagcagcagauggagaagggccccauugacgccaucacgggugaggcacgcuacucccugagugaggacaagcucauccggcagcagauugacuacaagacacugacccugaacugugugaacccugagaaugagaaugcaccugaggugccggugaaggggcuggacugugacacggucacccaggccaaggagaagcugcuggacgcugccuacaagggcgugcccuacucccagcggcccaaggccgcggacauggaccuggaguggcgccagggccgcauggcgcgcaucauccugcaggacgaggacgucaccaccaagauugacaacgauuggaagaggcugaacacacuggcucacuaccaggugacagacggguccucgguggcacuggugcccaagcagacguccgccuacaacaucuccaacuccuccaccuucaccaagucccucagcagauacgagagcaugcugcgcacggccagcagccccgacagccugcgcucgcgcacgcccaugaucacgcccgaccuggagagcggcaccaagcuguggcaccuggugaagaaccacgaccaccuggaccagcgugagggugaccgcggcagcaagauggucucggagaucuacuugacacggcuacuggccaccaagggcacacugcagaaguuuguggacgaccuguuugagaccaucuucagcacggcacaccggggcucagcccugccgcuggccaucaaguacauguucgacuuccuggaugagcaggccgacaagcaccagauccacgaugcugacgugcgccacaccuggaagagcaacugccugccccugcgcuucugggugaacgugaucaagaacccacaguuuguguucgacauucacaagaacagcaucacggacgccugcuugucggugguggcccagaccuucauggacuccugcuccaccucugagcacaagcugggcaaggacucacccuccaacaagcugcucuacgccaaggacauccccaacuacaagagcuggguggagagguacuaugcagacaucgccaagaugccagccaucagcgaccaggacaugagugcguaucuggcugagcagucccgccugcaccugagccaguucaacagcaugagcgccuugcacgagaucuacuccuacaucaccaaguacaaggaugagauccuggcagcccuggagaaggaugagcaggcgcggcggcagcggcugcggagcaagcuggagcaggugguggacacgauggcccugagcagcugagccccagcugugaucauccagcaugaugcagcgugaggacagcugagcagggaccgggacagcccucaccgcaugcguguggaguguccgguggugcucgggccgccgcagugcagcgacugcccggcccucccuccccugccucacccggucgggucccggcucuuccuguguggaggugaugguaccugccacaccacagcugcgcacacagcugcuugcucaggggccgggacagcacugggugcucaggcuggccaaggaccuucauugccuggcaagagcugcccaguggccuucaugggagaagggcugaccucugaggggcugaggggugaggccagggcccuccagggggagggguagccagcuugggcuguccccuugagaccaggacaagaggcugggggugucagcauucccagcuuuccaagcugcccccaggcggcagagucugagggucccggggcccgguuggcagcuggagaaagaggcaaaaagcccguagccgggcaagaggagcucaagucggucugggcccguugccaccgacucccaccuccagcacccaugcccgcugcaccgcugccauccucagauucaccgcgugcucugcgcggccgaggccggagcaccacauccaccucgccccagagaggcucugcucccuccuauggaggggcugugggccaggcugcucagacuccuggguggcuuccagacggaccgggcagccccucuccguccucagggcugugccucugggagccacugggccaggggccccgggucgcagagagcacguucccguuauuuauuccccuccgcguccuacacaggcugcccuggcagcugucuucaaggguaggcugagcuccccacccuggagccccugagggcggccccugagcacuccucucucuccacucucucugucccugccccagcggcuuccaguguggcaucucagcaguguccuggccccuccagagcagugggacaucuggggacuguuuuuguguuuaggggaaaaaauucugcugcacucugcuugggccuugaggucuguggcagggcuccucuggcccgcaguggccuggaucuaucugggccaugagugacgggcagugaccagagggacuggaggccagcgguguccacccuugcccucagcaagagagaaugcauucuuaaaagaaagcuguacauguauauauaugcauauauauauauguggcucuagccucaggcuccagccccagugggguacuguacaguuaacugaagaagaauuuuaaagacgauuugaacaagaaaaugaaggcagugggaaagcaaugccaaaugguuguggagaaaguggccggagccucccuggaguggagcagcccugaagccugugccccccgaccugcgggccgcuguuuugguuugacaugacaaggaaaggacuuccugcugacccugagagccucuggggugccgcggcaccacggggcaugcaugauugugcuagcguuuagucugaguugaucuuuuuaaaacugcaaguguugaauacuagagguuguuagacccuuuuuuauguuuuuuaauuaaucagucacuuguaaaagcaaacaagcgguccauccccuuuucaaggucacuuuuuugaugguaccgaagaucccauggacauuaagggacagcuaacuguggccagacucagccccauguccuuggccaggcccaaggagaggacucggccccauggggugugccagucuugcaguccgccccagcugaguagcgugagccagaugacgccacagagacccgccucuucccugaacgcgggucgguguggagucagugacugcugacucagggagcuccuuggccccgugggcacugugccagggcuggggccuucugcugcugccacacccagcucaggccugggccagccccugcccccagcccacugagggggugggcuuacucccugggcagucuugggggccagagcugaggccaguccauauuacaguggcugggcuguuuuuuucaguagccccuagcauuggcugggauuccuguuccugggugcgccuccaccucccuucugauguuuccuggcuaugguggggugggaaccucaguuucccccaaagucuucccuggaugcuggcuucagguugaagucccugguucuuccaguuccucacggguuagguaggggcuccugcaucaccuucagaauccaguuccaacccccacucuccuuaggccuugugcucugcucugcccugccaggcugcccuuguccaugugaguagcaugggcgggugguggggacggcaguggugaugaagggggugcaccacaggccucaugaagcaguucccacaugggcguguggcuggggcguggccaccacagagcacauggcugugucuaggcgcaagcacuuuagcaguaucuguuuacaugcgcaaggaucaagccgacuaccugugcugucuacugggacagcagucuccgagcuacuccguaccucccucugccaggucguggaguuaggccccagucccuacuugucacugguucccacugugcuccuaacugugcagcaccugggagcucuggccuggggcuggaggcccugguaggagcugcaguuggaggccguucugugcccagcagcggugagcggcucccaugggcccugugucugcagggagccagggcugcggcacaugugcugugaaacuggcacccaccuggcgugcugcugccgccacuugcuuccugcagcaccuccuacccugcuccguguccucccucuccccgcgccuggcucaggagugcuggaaaagcucacgccucggccugggagccuggccucuugauauaccucgagcuuccccugugcuccccagccccaggaccacuggccccuuggccugaggggcugggggccccacgaccugcagcgucgaguccgggagagagcccggagcggcgugccaucucggcucggccuugcugagagccuccgcccuggcuuucucccugucuggauucaguggcucacguuggugcuacacagcuagaauagauauauuuagagagagagauauuuuuaagacaaagcccacaauuagcuguccuuuaacaccgcagaacccccucccagaagaagagcgaucccucggacgguccgggcgggcacccucagccgggcucuuugcagaagcagcaccgcugacugugggcccggcccucagauguguacauauacggcuauuuccuauuuuacuguucuucagauuuaguacuuguaaauaaacacacacauuaaggagagauuaaacauuuuugcuaaaagcuaaaaa

SEQ ID NO: 193 - RNA, 11457 nt, Homo_Sapiens
cgccgccgccgccgccaccgcgggagccagagcugccgggaggagcggcauccgcgccagacuggagcgggagggcggcggagggcaguugcugggaauuuuucagccgagagggcgagcgauccggagagagaccccgagagcuugggagcgguagggcgugcgagcgccgcagccagcggagcaaaccucgaaauagaucuggaaagccaggcucccggaggaaaugggacugugaacgaaccggagagcaagaagggaaggaagcgccgggauugcugaugucagaggagcccggaaagucgcgcuggaaaaaucugaagacagccggggcucugcuucuuccucaggagagacaccgccggccgcccccacacgcccccucggcgccuccgggugcccccugagagccggcgacagcgcccagccgggcugcugcggggcgacggaggacugaggggcgcgcggagcggagaccgaggagcgacuucaggaauacagauaagugucugguggcuugacguggauuuuaaugaauuuggacuccauguggauuuggucgucucccugauuccgagcugcgggcagggagaggggccucgcgccgcccucagcagccggcggcggccgagguagaccgagcggggacggaaggacagaccgacgucgccgagcuggaaucaugugagggccaaccggggaagguggagcagaugagcacacacaggagccgucuccucaccgccgccccucucagcauggaacagaggcggcccuggccccgggcccuggagguggacagccgcucugugguccugcucucaguggucugggugcugcuggcccccccagcagccggcaugccucaguucagcaccuuccacucugagaaucgugacuggaccuucaaccacuugaccguccaccaagggacgggggccgucuaugugggggccaucaaccgggucuauaagcugacaggcaaccugaccauccagguggcucauaagacagggccagaagaggacaacaagucuuguuacccgccccucaucgugcagcccugcagcgaagugcucacccucaccaacaaugucaacaagcugcucaucauugacuacucugagaaccgccugcuggccugugggagccucuaccagggggucugcaagcugcugcggcuggaugaccucuucauccugguggagccaucccacaagaaggagcacuaccuguccagugucaacaagacgggcaccauguacggggugauugugcgcucugagggugaggauggcaagcucuucaucggcacggcuguggaugggaagcaggauuacuucccgacccuguccagccggaagcugccccgagacccugaguccucagccaugcucgacuaugagcuacacagcgauuuugucuccucucucaucaagaucccuucagacacccuggcccuggucucccacuuugacaucuucuacaucuacggcuuugcuagugggggcuuugucuacuuucucacuguccagcccgagaccccugaggguguggccaucaacuccgcuggagaccucuucuacaccucacgcaucgugcggcucugcaaggaugaccccaaguuccacucauacgugucccugcccuucggcugcacccgggccgggguggaauaccgccuccugcaggcugcuuaccuggccaagccuggggacucacuggcccaggccuucaauaucaccagccaggacgauguacucuuugccaucuucuccaaagggcagaagcaguaucaccacccgcccgaugacucugcccugugugccuucccuauccgggccaucaacuugcagaucaaggagcgccugcaguccugcuaccagggcgagggcaaccuggagcucaacuggcugcuggggaaggacguccagugcaccaaggcgccuguccccaucgaugauaacuucuguggacuggacaucaaccagccccugggaggcucaacuccaguggagggccugacccuguacaccaccagcagggaccgcaugaccucuguggccuccuacguuuacaacggcuacagcgugguuuuuguggggacuaagaguggcaagcugaaaaagauucgggccgacggucccccccauggugggguccaguacgagauggucucugugcucaaggacggaagccccauccuccgggacauggccuucuccauugaucagcgcuaccuguacgucaugucugagagacaggucaccaggguccccguggagucaugugagcaguauacgacuuguggggagugccugagcucuggggacccucacuguggcuggugugcccugcacaacaugugcucccgcagggacaaaugccaacaggccugggaaccuaaucgauuugcugccagcaucagccagugugugagccuugcagugcaucccagcagcaucucaguaucugagcacagccgguugcuuagccugguagugagugaugcuccugaucuaucugcggguaucgccugugccuuugggaaccugacagagguggaggggcagguguccgggagccaggucaucugcaucucaccugggcccaaggaugucccugucaucccgcuggaucaagacugguuugggcuggagcuacagcugagguccaaggagacagggaagauauuugucagcaccgaguucaaguuuuacaacugcagugcccaccaacugugccuguccugugucaacagcgccuuccgcugccauuggugcaaguaccgcaaccucugcacucaugaccccaccaccugcuccuuccaggagggccggaucaauauuucagaggacuguccccagcuggugcccacagaggagaucuugauuccagucggggagguaaagccaaucacccuuaaggcgcgaaaucugccccagccgcaguccggccagcgaggcuaugaguguguccucaacauacaaggagccauccaccggguccccgcucugcgcuucaacagcuccagcguucagugucagaacagcucguaccaguaugauggcauggacaucagcaaucuggccguggauuucgcugugguguggaacggcaauuucaucauugacaacccucaggaccugaaaguccaucucuacaagugugcagcccagcgggagagcugcggccucugccucaaggccgaccggaaguuugaguguggcuggugcagcggcgagcgcaggugcacccuccaccagcacuguaccagcccuuccagccccuggcucgacugguccagccacaaugucaagugcuccaacccucaaaucaccgagauuuugacggugucuggaccgccggaaggagggacgcgagugaccauccauggcgugaaccugggucuggacuucuccgagaucgcccaccaugugcagguggcuggggugcccugcacgccccucccaggggaauacaucaucgcugagcagauugucugugagaugggccaugcccucgugggaaccaccuccgggccaguacgccuguguauuggcgaguguaagccagaguucaugacgaagucccaucagcaguacaccuucgugaacccuucugugcugucacucaacccaauccgaggucccgagucaggaggcacuauggugaccauuaccggccauuaccuuggggcugggagcagcguggcagucuaccugggcaaccagaccugcgaguucuacgggaggucaaugagugagaucgugugugucucacccccaucauccaauggccuuggcccggucccuguuucugugagugucgaccgagcccauguggauagcaaccugcaguuugaguacauagaugacccucggguccagcgcaucgagccagaguggagcauugccaguggccacacaccccugaccaucacaggcuucaaccuggaugucauucaggagccaaggauccgagucaaauucaauggcaaagaaucugucaauguguguaaaguugugaacacaaccacccucaccugccuggcacccucucugaccacggacuaccgcccuggccuggacacuguggaacgcccagaugaguuuggauuugucuuuaacaauguccaauccuugcuaauuuacaacgacaccaaguuuaucuacuaccccaacccgaccuuugaacugcuuagcccuacuggagucuuggaucaaaagccaggaucgcccaucauucugaagggcaaaaaccucugcccuccugccucuggaggggccaaacucaacuacacugugcucaucggagagaccccuugugcugucaccguaucugagacccagcuucucugcgagccucccaaccucaccgggcagcacaaggucaugguucacgugggcgggaugguguucucgccuggcucggugagugucaucucagacagcuugcugacccugccagccaucgucagcaucgcggccggcggcagccuccuccucaucaucgucaucaucguccucauugccuacaagcgcaagucucgagaaaaugaccucacucucaagcggcugcaaaugcagauggacaaucuggagucccguguggccuuggagugcaaggaagcuuuugcugagcuccagacggauaucaaugaguugaccagugaccuggaccgcucaggaaucccuuaccuggacuaucguaccuacgcuaugcgaguccuguucccgggcaucgaggaccaccccguccugcgggagcuggagguacaaggaaacgggcagcagcacguggagaaggcccugaagcucuuugcccagcucaucaacaacaagguguuccugcugaccuucauccgcacccuggagcugcagcgcaguuucuccaugcgcgaccggggcaacguggcuucgcucaucaugaccggccugcagggccgccuggaauaugccacugauguccucaagcagcugcucucugaccucaucgauaagaaccuggagaacaagaaccaccccaagcugcuacuccggaggacagagucuguggcugaaaagaugcugaccaauugguucgccuuccuccugcacaaguuccuaaaggagugcgcaggggagccacucuucaugcuauacugugccaucaagcagcagauggagaagggccccauugaugccaucacgggcgaggcccgcuacucccugagcgaggacaagcucauccggcagcagaucgaguacaagacccugauccugaacugcgucaacccugacaacgagaacaguccagagaucccagugaagguguuaaacugugacaccaucacacaggucaaggagaagauucuugaugccguguauaagaaugugcccuauucccagcggccgagggcaguggacauggacuuggaguggcgccaaggccggaucgcccgggucgugcugcaagaugaggacaucaccaccaagauugagggugacuggaagcggcucaacacacugaugcauuaucaggugucagacaggucggugguggcucugguccccaaacagaccuccuccuacaacaucccugccucugccagcaucucccggacguccaucagcagauacgacuccuccuucagguauacgggcagccccgacagccugcggucccgggccccgaugaucaccccagaccuggaaaguggggucaagguguggcaucuggugaagaaccaugaccacggugaccagaaggagggugaccggggcagcaagaugguguccgagaucuaccugacccggcuacuggccaccaagggcacccugcagaaguuuguggacgacuuguuugagaccuuguucagcacugugcaccggggcagcgcucucccccuggccaucaaguacauguuugauuuccuagaugagcaggcagacaggcacagcauccaugacacagaugugcggcacaccuggaaaagcaacugccucccucugcgcuucugggugaacgugauuaagaacccccaguucguguuugacauccacaagggcagcaucacggacgccugccucucugugguggcccagaccuucauggacucuuguucaacgucagagcaccggcugggcaaggacucccccuccaacaagcugcucuaugccaaggacauccccagcuacaagagcuggguggagagauacuacgcagacaucgccaagcucccagccaucagugaccaggacaugaaugccuaccucgccgagcagucccgccugcacgccguggaguucaacaugcugagugcccucaaugagaucuacuccuaugucagcaaguauagugaggagcucaucggggcccuagagcaggaugagcaggcacggcggcagcggcuggcuuauaagguggagcagcucauuaaugccauguccauugagagcugagaggaggagccucgcauuccugggaagagggaccuguccaagcugucacacugggagucucagauggaaggacaagugauggggaucaggccccagagcuugcuguccccugagaccccauccuggggagaggggaggacuccucucccuacgccagccaaguuucgucauagccaguuccagcugggagagacagugggcgucguccauccucagugagaacaccagagaacccggggccgggagaaggugguucuucaagccgagaggcacgagcuggggacaguucugccucugugacugcugcuuugcaugaaaacucauuugauguauauuggggaaauaaugagaacuuuauuuaauuuuuuuaagaaaaagggaaaaaaacagaaauaaaacaaaaagccgcccuguuaaucccguccaacuuuuguuuaauucugauuucugucucccuuccaucuuuucucccauuccuccuucuuuauauaaugccuauuuccaaaugccagagaaagcagagaugcugagagacauuggagagaaaaugacugucuccuuuuccuugaaauuaaaaaaaaaaaaaaaaagagaaagaggagaagaagaaugaugagcacaaguaugcaccaaacacuucgcaaaaacagaggccaguaaaaccuggaauuaucccggcagccagaggaguauggaacuuccagaacuuugcacaaauugcaaagccaucaagagcucacccuggcugacuggaaacugagcuuuaucuaccacacaccuguauauucucaucuuuugagaggagauguguaccuagauaguaccaaugcuuuuugcuacuguuuuuuguuuuguuuuauuuaauccuaaaccucaacaaaugaggagcuggucuuugauauguuuccuuucaauuucccuaaaguuacuaugagaaguggggugaggugggccucucccagaccagacaccuggcagcccugccucauaucaaucccugucauaaaccaggcacccuggggaaacggccuggaggugugugggccaggccuccacgagguuccauuugaaaguugauuuggagacauagguguuugacuuuggaguucacuccaaucauccaguggucccuggcaauuaaaaagaaaacaaaaaucaaacacuguuuacagcaagcaauacuugaagagcauagguuacagaagcugcaguauuuauuauuaugcuuucuuucuuucauucucucgugccuggagaggggagaccacccuucgcucauauacggaagcuccugaccaucugggccuacagcacuuccucaguagaaaugacuguggcaugcccacguuacuaccuucugccucucuuucugccucucacggacuugugagugugaaggacaaguggaugacuucucacuggacuuuccuucucugucucuucugaugaugccuaaaacuauggauaaccaauucuccugaguguagauuccaaacaaagagaccaaagcuccaugcccagguccaaaggccccauagaagccagugggagucaucgagaggaaaggcgcucugugagugucaggaccuugguggccaggauagccaucagaguguccaggccucccacauuaccuuggauccgagcagccagcuccaacuguucugcaagcagcacuggagucaggggguaggaggacaaguggaagcaaaggugugggacuggggaagacaaagaggaacaagcugcccuuccucacuuuucaaagggucaggaauccuaggcuaugaugcugggaagcuagaccagcuccuccaagagagacuagaccagggucauuuucucuguuauuaacucugggcuccagcuucuccgugcccugcuuuaccuccaagugguuccaauuuccaaaggcccugcugaccacaugugauucccaggagagggcugggggaggggagcgcagaggucuggcuuccauccuuggcguguagcuuuggaucgcugucuaaccacacagcagacguugcccggucuccccagcucuaguuucuugccugaaugcggcugacaaaugggaagagaaaagcauucagcaaaauacucaggaaacuugcuguuuucauuauaauucacaaccagccaugccaaggccacuuucuuuugaaaauccacuucuuuaaaguuucucaggcccuauuaguagccugaaggaaauacuaaugacuggccuuccgcacuaagccaaaguguuugcucuucauagcacucaaagcuuaucagcgcagagcccauaauuuauggagauaaaaggaaaggagauauagguaagaagagugugaccaggagaccuuaugcuaccuguaaaaaaguucagcccaccccaucuaacuucugagcucuguuugggugaagauuuucuggccgcauggcugcucagacuggcauccaggcuuugcuccaccaagaaguuaaaggcagucggacaucucaguagcaucucuaccagcccuuaacucaaugcaucuaccuggcaucucccagcaguuacuuuuggagacgauucacugccccuggggcguuuccuugaagguuuguggagagcguggagaaugauggggcaauggccaauuggaggguggagagugaagagccggagcuggcugugagugguuuggccacauuucucaggauuccaugagagacuuggggaacuugggcugacaaaggaaguagccuggggcauccuuaaggaaggaauuaagaaaagggaaaaagcuggacucaagccacgccaugagggugaaagguuauaaggcccugcccccuuuccagcugcccaccuguuccuccuccacaccucuucgcuuugggccaccaagaaccaaugaaguccacacccuuuggaugagaaaaagagggaguugguuggccucucuucucccuguuauccaauuugaggauauuuugaccuuggguaaggaugaaguguuaaagccacagcuccucuccacaagaagccauucaucuugggggaggcagagagggaagucucucuccaaagucuauccagcuucgcuucguuucauugaucugcacaagagacaaugcucuggaaaaggaagaggaccccagaagggugcuuggcaagacagaggaugcuaaugggcaauggagagcacucccuccagcuggccccugcugcugccucccguccucugcauggggucaggugcuucugugcuugcuguccuaccucucuccacagcagggcucucaaaaccauuuugaucccccauuggcagaggguuccccucuuuacagaguucagucauuaaaagcauggaucagcuguuaaucucauuggaggagggaacuguuuccugcauucauucaucugggaaccuucuugaguagccacugucugccagccacugcucuagagaugggaaaacagcacggaacaaaaccaaggucuuucuuccagcgaauuuauauccuucaggaagcugguuccugccaccaacuuagcaggcaacaguucuccuccccuaguggcacaggguaccaguuuuguaggaaaagugguccagcaaaggaagaaagcagaccaacccagcugccuuaccuuauucuggggccauucccccagcgaugagagcugcucuuguuucuacugccaccaucucuucuggcugcacuucaccugcugcuugagcuucugaccuuccuucaguuccaccaaaugaggacaggaaauagcagucaagaccccuggcccugcugagcgugaaacagaagcaauggaugagugcuggacgaagaauggccugggcagaacaaauagggagcauuugaaagcuucuggcugauaaaucuccaggugcaucccgguugccacgccugcccccauuaaccugcuccugguaaauacugauccagcagcugcuccaggagaggccgucuuuuuuucccagccacgcugugucuugcaugagacuccuggggccugggcacagagagaaaagaauugagacucaggaggcucagugggugagaaaaugcaaaguggcuucacagacacagggcugugggagcagaucgacggggaacuugggagaugaacuucagggccuuccgacgccuugucucaggaacaugcuuugagaaaaaugguagcauccuuuccauaacucagucucucuucccuaguuucccugaagugugacguuuuaguaucuggagcucagugauccccaugaaugagggauaaaguuucacucuugguauuuucuaacuagugcuagggaaaguccugagacacgaucacagccacugcuuggcauacagggccuccacccaauaagcaaacuggagauuccucagccucucguggacacccacaucucauucuucucacagcagagaagcucucccuucagccugagcugucuucuuucugcugcagugcagccugcucccuccuacccuggccucaaggaagguaggaaacaucuucugcauuucaaaguccucacuuugacuuauuuggccuucaucuuggcauggaagguggcaggcagaauggaaauacuccccccaaacagaacagauauucuugcguguguaagggcagaagggacaagcucucuaucccaugagacuaggggccggagcccaccugccuuuccccacaacuuuuccugcucaaacccacuccucuugacacacuggaaucuguauuauauauauuuuuaagaaaauacaaugaugguugucugguuuuguuguuuuuacagguguuguggaauaaaaacuguaagaaaauuaaguauuuaaaauguuccaauaaagugggguuuuuuguuauucuaauauauuauuguguaccuauuguaaauaugaaacacuccuauuuugcaagcugaggacacaauuuguacuguuguuauauauaaauaaaguuuacugaauuaaaaaaaccuuaaaucuuuaaauaaaaaaaaaaaaaaaa

SEQ ID NO: 194 - RNA, 7325 nt, Homo_Sapiens
gcccggccgacgcggcuuugucuccuuuguucccggcgguggcagcgccgcgcgggaggggcgggcagcgggcgcaguuuuccgccccucggucuccggguaacagcugcggcuccaccagacccggggagaggccgcugcgcgcggagcccgagcccggagcggccgacgcccgccucggcgcgcacaucccgcggggcccggccggguggugacucccacacgggucaugcuguugucuccugauccagccggcccugccaggugaccaugccugcucugggcccagcucuucuccaggcucucugggccggguggguccucacccuccagccccuuccaccaacugcauucacucccaauggcacguaucugcagcaccuggcaagggaccccaccucaggcacccucuaccugggggcuaccaacuuccuguuccagcugagcccugggcugcagcuggaggccacaguguccaccggcccugugcuagacagcagggacugccugccaccugugaugccugaugagugcccccaggcccagccuaccaacaacccgaaucagcugcuccuggugagcccaggggcccuggugguaugcgggagcgugcaccagggggucugugaacagcggcgccuggggcagcucgagcagcugcugcugcggccagagcggccuggggacacacaauauguggcugccaaugauccugcggucagcacgguggggcugguagcccagggcuuggcaggggagccccuccuguuuguggggcgaggauacaccagcaggggugugggggguggcauuccacccaucacaacccgggcccuguggccgcccgacccccaagcugccuucuccuaugaggagacagccaagcuggcagugggccgccucuccgaguacagccaccacuucgugagugccuuugcacguggggccagcgccuacuuccuguuccugcggcgggaccugcaggcucagucuagagcuuuucgugccuauguaucucgagugugucuccgggaccagcacuacuacuccuauguggaguugccucuggccugcgaagguggccgcuacgggcugauccaggcugcagcuguggccacguccagggagguggcgcauggggaggugcucuuugcagcuuucuccucggcugcaccccccacugugggccggcccccaucggcggcugcuggggcaucuggagccucugcccucugugccuucccccuggaugagguggaccggcuugcuaaucgcacgcgagaugccugcuacacccgggagggucgugcugaggaugggaccgagguggccuacaucgaguaugaugucaauucugacugugcacagcugccaguggacacccuggaugcuuaucccuguggcucagaccacacgcccagccccauggccagccgggucccgcuggaagccacaccaauucuggaguggccagggauucagcuaacagcuguggcagucaccauggaagauggacacaccaucgcuuuccugggugauagucaagggcagcugcacagggucuacuugggcccagggagcgauggccacccauacuccacacagagcauccagcaggggucugcagugagcagagaccucaccuuugaugggaccuuugagcaccuguaugucaugacccagagcacacuucugaagguuccuguggcuuccugugcucagcaccuggacugugcaucuugccuugcucacagggacccauacuguggguggugcgugcuccuuggcaggugcagucgccguucugagugcucgaggggccagggcccagagcaguggcuauggagcuuccagccugagcugggcugucugcaaguggcagccaugaguccugccaacaucagccgagaggagacgagggagguuuuccuaucagugccagaccugccaccccuguggccaggggagucauauuccugccacuuuggggaacaucagaguccugcccugcugacugguucuggugugaugugccccuccccagacccuagugaggccccagugcugccgagaggagccgacuacguauccgugagcguggagcucagauuuggcgcuguugugaucgccaaaacuucccucucuuucuaugacuguguggcggucacugaacuccgcccaucugcgcagugccaggccugugugagcagccgcuggggguguaacuggugugucuggcagcaccugugcacccacaaggccucgugugaugcugggcccaugguugcaagccaucagagcccgcuugucuccccagacccuccugcaagagguggacccagccccuccccacccacagcccccaaagcccuggccaccccugcuccugacacccuucccguggagccuggggcucccuccacagccacagcuucggacaucucaccuggggcuaguccuucccugcucagccccugggggccaugggcagguucuggcuccauaucuuccccuggcuccacagggucgccucuccaugaggagcccuccccucccagcccccaaaauggaccuggaaccgcugucccugcccccacugacuucagacccucagccacaccugaggaccucuuggccuccccgcugucaccgucagagguagcagcagugcccccugcagacccuggccccgaggcucuucaucccacagugccccuggaccugcccccugccacuguuccugccaccacuuucccaggggccaugggcuccgugaagcccgcccuggacuggcucacgagagaaggcggcgagcugcccgaggcggacgaguggacggggggugacgcacccgccuucuccacuuccacccuccucucaggugauggagacucagcagagcuugagggcccucccgccccccucauccucccguccagccucgacuaccaguaugacacccccgggcucugggagcuggaagaggcgaccuugggggcaagcuccugccccuguguggagagcguucagggcuccacguugaugccgguccauguggagcgggaaauccggcugcuaggcaggaaccugcaccuuuuccaggauggcccaggagacaaugagugugugauggagcuggagggccucgagguggugguugaggcccgggucgagugugagccaccuccagauacccagugccaugucaccugccagcagcaccagcucagcuaugaggcucugcagccggagcuccguguggggcuguuucugcgucgggccggccgucugcguguggacagugcugaggggcugcaugugguacuguaugacuguuccgugggacauggagacugcagccgcugccaaacugccaugccccaguauggcuguguguggugugagggggagcguccacguugugugacccgggaggccuguggugaggcugaggcuguggccacccagugcccagcgccccucauccacucgguggagccacugacugggccuguagacggaggcacccgugucaccaucaggggcuccaaccugggccagcaugugcaggaugugcugggcauggucacgguggcuggagugcccugugcuguggaugcccaggaguacgaggucuccagcagccucgugugcaucaccggggccaguggggaggagguggccggcgccacagcgguggaggugccgggaagaggacguggugucucagaacacgacuuugccuaccaggauccgaagguccauuccaucuucccggcccgcggccccagagcugggggcacccgucucacccugaauggcuccaagcuccugacugggcggcuggaggacauccgaguggugguuggagaccagccuugucacuugcugccggagcagcagucagaacaacugcggugugagaccagcccacgccccacgccugccacgcucccuguggcugugugguuuggggccacggagcggaggcuucaacgcggacaguucaaguauaccuuggaccccaacaucaccucugcuggccccaccaagagcuuccucaguggaggacgugagauaugcguccguggccagaaucuggacgugguacagacgccaagaauccgggugaccguggucucgagaaugcugcagcccagccaggggcuuggacggaggcgucgcguggucccggagacggcauguucccuuggacccuccugcaguagccagcaauuugaggagccgugccaugucaacuccucccagcucaucacgugccgcacaccugcccucccaggccugccugaggaccccuggguccggguggaauuuauccuugacaaccuggucuuugacuuugcaacacugaaccccacaccuuucuccuaugaggccgaccccacccugcagccacucaacccugaggaccccaccaugccauuccggcacaagccugggaguguguucuccguggagggggagaaccuggaccuugcaauguccaaggaggaggugguggcuaugauaggggauggccccuguguggugaagacgcugacgcggcaccaccuguacugcgagccccccguggagcagccccugccacggcaccaugcccuccgagaggcaccugacucuuugccugaguucacggugcagauggggaacuugcgcuucucccugggucacgugcaguaugacggcgagagcccuggggcuuuuccuguggcagcccaggugggcuugggggugggcaccucucuucuggcucugggugucaucaucauuguccucauguacaggaggaagagcaagcaggcccugagggacuauaagaagguucagauccagcuggagaaucuggagagcagugugcgggaccgcugcaagaaggaauucacagaccucaugacugagaugaccgaucucaccagugaccuccugggcagcggcauccccuuccucgacuacaagguguaugcggagaggaucuucuucccugggcaccgcgagucgcccuugcaccgggaccugggugugccugagagcagacggcccacuguggagcaagggcuggggcagcucucuaaccugcucaacagcaagcucuuccucaccaaguucauccacacgcuggagagccagcgcaccuuuucagcucgggaccgugccuacguggcaucucugcucaccguggcacugcaugggaagcuugaguauuucacugacauccuccgcacucugcucagugaccugguugcccaguauguggccaagaaccccaagcugaugcugcgcaggacagagacugugguggagaagcugcucaccaacuggauguccaucugucuguauaccuucgugagggacuccguaggggagccucuguacaugcucuuucgagggauuaagcaccaaguggauaaggggccaguggacagugugacaggcaaggccaaauacaccuugaacgacaaccgccugcucagagaggauguggaguaccguccccugaccuugaaugcacuauuggcuguggggccuggggcaggagaggcccagggcgugcccgugaagguccuagacugugacaccaucucccaggcaaaggagaagaugcuggaccagcuuuauaaaggagugccucucacccagcggccagacccucgcacccuugauguugaguggcggucugggguggccgggcaccucauucuuucugacgaggaugucacuucugagguccagggucuguggaggcgccugaacacacugcagcauuacaaggucccagauggagcaacuguggcccucguccccugccucaccaagcaugugcuccgggaaaaccaggauuaugucccuggagagcggaccccaaugcuggaggauguagaugaggggggcauccggcccuggcaccuggugaagccaagugaugagccggagccgcccaggccucggaggggcagccuucggggcggggagcgugagcgcgccaaggccaucccugagaucuaccugacccgccugcuguccaugaagggcacccugcagaaguucguggaugaccuguuccaggugauucucagcaccagccgccccgugccgcucgcugugaaguacuucuuugaccugcuggaugagcaggcccagcagcauggcaucuccgaccaggacaccauccacaucuggaagaccaacagcuugccucugagguucuggaucaauauaauaaaaaacccgcaguuuguguucgacgugcaaacaucugauaacauggaugcggugcuccuugucauugcacagaccuucauggacgccugcacccuggccgaccacaagcugggccgggacuccccgaucaacaaacuucuguaugcacgggacauuccccgguacaagcggaugguggaaagguacuaugcagacaucagacagacugucccagccagcgaccaagagaugaacucuguccuggcugaacuguccuggaacuacuccggagaccucggggcgcgaguggcccugcaugaacucuacaaguacaucaacaaguacuaugaccagaucaucacugcccuggaggaggauggcacggcccagaagaugcagcugggcuaucggcuccagcagauugcagcugcuguggaaaacaaggucacagaucuauaggaacccaggagccacggccugcuguugcuucagccuggccugggcagcccuggaagcucggaggagaggccaccuucuuaggugccuguagugacugacaagcagaguuaguggaaggugacucccagucuccugguggcucuggccucggcccugcuggauccaccuccuagacccggggccucaaggcucaugggguaguacccagccugcuccccgaguccagcgacccugugacaccggucugcagggaguuggggacuaagggcuuccagagaguggcuggaagagacuccaggccccuggggagacuguacuguuccugaacacuggccuuggccacacugggauucggagaggaaggaggagagccccaugcuuccugucugccuccuccaccaucccugaccucaguugagcugccucuggccuuguugcugcugccacauccuaggucuaagaguugaacgccucuccuaggccacuacaaacugaccccucagcagggcuggcugccacagggcugcccugccucauagguagccauggugagggcuaucugcugcaggggggucuuggggagaguggugacuccauugacccagcuuuucauuaaaggauaacacacugcaaaaaaaaaaaaaaaa

SEQ ID NO: 195 - RNA, 7158 nt, Homo_Sapiens
agggccaggugcgcaggggagaaacaaggcgccuuggaguucaggugacucccacacgggucaugcuguugucuccugauccagccggcccugccaggugaccaugccugcucugggcccagcucuucuccaggcucucugggccggguggguccucacccuccagccccuuccaccaacugcauucacucccaauggcacguaucugcagcaccuggcaagggaccccaccucaggcacccucuaccugggggcuaccaacuuccuguuccagcugagcccugggcugcagcuggaggccacaguguccaccggcccugugcuagacagcagggacugccugccaccugugaugccugaugagugcccccaggcccagccuaccaacaacccgaaucagcugcuccuggugagcccaggggcccuggugguaugcgggagcgugcaccagggggucugugaacagcggcgccuggggcagcucgagcagcugcugcugcggccagagcggccuggggacacacaauauguggcugccaaugauccugcggucagcacgguggggcugguagcccagggcuuggcaggggagccccuccuguuuguggggcgaggauacaccagcaggggugugggggguggcauuccacccaucacaacccgggcccuguggccgcccgacccccaagcugccuucuccuaugaggagacagccaagcuggcagugggccgccucuccgaguacagccaccacuucgugagugccuuugcacguggggccagcgccuacuuccuguuccugcggcgggaccugcaggcucagucuagagcuuuucgugccuauguaucucgagugugucuccgggaccagcacuacuacuccuauguggaguugccucuggccugcgaagguggccgcuacgggcugauccaggcugcagcuguggccacguccagggagguggcgcauggggaggugcucuuugcagcuuucuccucggcugcaccccccacugugggccggcccccaucggcggcugcuggggcaucuggagccucugcccucugugccuucccccuggaugagguggaccggcuugcuaaucgcacgcgagaugccugcuacacccgggagggucgugcugaggaugggaccgagguggccuacaucgaguaugaugucaauucugacugugcacagcugccaguggacacccuggaugcuuaucccuguggcucagaccacacgcccagccccauggccagccgggucccgcuggaagccacaccaauucuggaguggccagggauucagcuaacagcuguggcagucaccauggaagauggacacaccaucgcuuuccugggugauagucaagggcagcugcacagggucuacuugggcccagggagcgauggccacccauacuccacacagagcauccagcaggggucugcagugagcagagaccucaccuuugaugggaccuuugagcaccuguaugucaugacccagagcacacuucugaagguuccuguggcuuccugugcucagcaccuggacugugcaucuugccuugcucacagggacccauacuguggguggugcgugcuccuuggcaggugcagucgccguucugagugcucgaggggccagggcccagagcaguggcuauggagcuuccagccugagcugggcugucugcaaguggcagccaugaguccugccaacaucagccgagaggagacgagggagguuuuccuaucagugccagaccugccaccccuguggccaggggagucauauuccugccacuuuggggaacaucagaguccugcccugcugacugguucuggugugaugugccccuccccagacccuagugaggccccagugcugccgagaggagccgacuacguauccgugagcguggagcucagauuuggcgcuguugugaucgccaaaacuucccucucuuucuaugacuguguggcggucacugaacuccgcccaucugcgcagugccaggccugugugagcagccgcuggggguguaacuggugugucuggcagcaccugugcacccacaaggccucgugugaugcugggcccaugguugcaagccaucagagcccgcuugucuccccagacccuccugcaagagguggacccagccccuccccacccacagcccccaaagcccuggccaccccugcuccugacacccuucccguggagccuggggcucccuccacagccacagcuucggacaucucaccuggggcuaguccuucccugcucagccccugggggccaugggcagguucuggcuccauaucuuccccuggcuccacagggucgccucuccaugaggagcccuccccucccagcccccaaaauggaccuggaaccgcugucccugcccccacugacuucagacccucagccacaccugaggaccucuuggccuccccgcugucaccgucagagguagcagcagugcccccugcagacccuggccccgaggcucuucaucccacagugccccuggaccugcccccugccacuguuccugccaccacuuucccaggggccaugggcuccgugaagcccgcccuggacuggcucacgagagaaggcggcgagcugcccgaggcggacgaguggacggggggugacgcacccgccuucuccacuuccacccuccucucaggugauggagacucagcagagcuugagggcccucccgccccccucauccucccguccagccucgacuaccaguaugacacccccgggcucugggagcuggaagaggcgaccuugggggcaagcuccugccccuguguggagagcguucagggcuccacguugaugccgguccauguggagcgggaaauccggcugcuaggcaggaaccugcaccuuuuccaggauggcccaggagacaaugagugugugauggagcuggagggccucgagguggugguugaggcccgggucgagugugagccaccuccagauacccagugccaugucaccugccagcagcaccagcucagcuaugaggcucugcagccggagcuccguguggggcuguuucugcgucgggccggccgucugcguguggacagugcugaggggcugcaugugguacuguaugacuguuccgugggacauggagacugcagccgcugccaaacugccaugccccaguauggcuguguguggugugagggggagcguccacguugugugacccgggaggccuguggugaggcugaggcuguggccacccagugcccagcgccccucauccacucgguggagccacugacugggccuguagacggaggcacccgugucaccaucaggggcuccaaccugggccagcaugugcaggaugugcugggcauggucacgguggcuggagugcccugugcuguggaugcccaggaguacgaggucuccagcagccucgugugcaucaccggggccaguggggaggagguggccggcgccacagcgguggaggugccgggaagaggacguggugucucagaacacgacuuugccuaccaggauccgaagguccauuccaucuucccggcccgcggccccagagcugggggcacccgucucacccugaauggcuccaagcuccugacugggcggcuggaggacauccgaguggugguuggagaccagccuugucacuugcugccggagcagcagucagaacaacugcggugugagaccagcccacgccccacgccugccacgcucccuguggcugugugguuuggggccacggagcggaggcuucaacgcggacaguucaaguauaccuuggaccccaacaucaccucugcuggccccaccaagagcuuccucaguggaggacgugagauaugcguccguggccagaaucuggacgugguacagacgccaagaauccgggugaccguggucucgagaaugcugcagcccagccaggggcuuggacggaggcgucgcguggucccggagacggcauguucccuuggacccuccugcaguagccagcaauuugaggagccgugccaugucaacuccucccagcucaucacgugccgcacaccugcccucccaggccugccugaggaccccuggguccggguggaauuuauccuugacaaccuggucuuugacuuugcaacacugaaccccacaccuuucuccuaugaggccgaccccacccugcagccacucaacccugaggaccccaccaugccauuccggcacaagccugggaguguguucuccguggagggggagaaccuggaccuugcaauguccaaggaggaggugguggcuaugauaggggauggccccuguguggugaagacgcugacgcggcaccaccuguacugcgagccccccguggagcagccccugccacggcaccaugcccuccgagaggcaccugacucuuugccugaguucacggugcagauggggaacuugcgcuucucccugggucacgugcaguaugacggcgagagcccuggggcuuuuccuguggcagcccaggugggcuugggggugggcaccucucuucuggcucugggugucaucaucauuguccucauguacaggaggaagagcaagcaggcccugagggacuauaagaagguucagauccagcuggagaaucuggagagcagugugcgggaccgcugcaagaaggaauucacagaccucaugacugagaugaccgaucucaccagugaccuccugggcagcggcauccccuuccucgacuacaagguguaugcggagaggaucuucuucccugggcaccgcgagucgcccuugcaccgggaccugggugugccugagagcagacggcccacuguggagcaagggcuggggcagcucucuaaccugcucaacagcaagcucuuccucaccaaguucauccacacgcuggagagccagcgcaccuuuucagcucgggaccgugccuacguggcaucucugcucaccguggcacugcaugggaagcuugaguauuucacugacauccuccgcacucugcucagugaccugguugcccaguauguggccaagaaccccaagcugaugcugcgcaggacagagacugugguggagaagcugcucaccaacuggauguccaucugucuguauaccuucgugagggacuccguaggggagccucuguacaugcucuuucgagggauuaagcaccaaguggauaaggggccaguggacagugugacaggcaaggccaaauacaccuugaacgacaaccgccugcucagagaggauguggaguaccguccccugaccuugaaugcacuauuggcuguggggccuggggcaggagaggcccagggcgugcccgugaagguccuagacugugacaccaucucccaggcaaaggagaagaugcuggaccagcuuuauaaaggagugccucucacccagcggccagacccucgcacccuugauguugaguggcggucugggguggccgggcaccucauucuuucugacgaggaugucacuucugagguccagggucuguggaggcgccugaacacacugcagcauuacaaggucccagauggagcaacuguggcccucguccccugccucaccaagcaugugcuccgggaaaaccaggauuaugucccuggagagcggaccccaaugcuggaggauguagaugaggggggcauccggcccuggcaccuggugaagccaagugaugagccggagccgcccaggccucggaggggcagccuucggggcggggagcgugagcgcgccaaggccaucccugagaucuaccugacccgccugcuguccaugaagggcacccugcagaaguucguggaugaccuguuccaggugauucucagcaccagccgccccgugccgcucgcugugaaguacuucuuugaccugcuggaugagcaggcccagcagcauggcaucuccgaccaggacaccauccacaucuggaagaccaacagcuugccucugagguucuggaucaauauaauaaaaaacccgcaguuuguguucgacgugcaaacaucugauaacauggaugcggugcuccuugucauugcacagaccuucauggacgccugcacccuggccgaccacaagcugggccgggacuccccgaucaacaaacuucuguaugcacgggacauuccccgguacaagcggaugguggaaagguacuaugcagacaucagacagacugucccagccagcgaccaagagaugaacucuguccuggcugaacuguccuggaacuacuccggagaccucggggcgcgaguggcccugcaugaacucuacaaguacaucaacaaguacuaugaccagaucaucacugcccuggaggaggauggcacggcccagaagaugcagcugggcuaucggcuccagcagauugcagcugcuguggaaaacaaggucacagaucuauaggaacccaggagccacggccugcuguugcuucagccuggccugggcagcccuggaagcucggaggagaggccaccuucuuaggugccuguagugacugacaagcagaguuaguggaaggugacucccagucuccugguggcucuggccucggcccugcuggauccaccuccuagacccggggccucaaggcucaugggguaguacccagccugcuccccgaguccagcgacccugugacaccggucugcagggaguuggggacuaagggcuuccagagaguggcuggaagagacuccaggccccuggggagacuguacuguuccugaacacuggccuuggccacacugggauucggagaggaaggaggagagccccaugcuuccugucugccuccuccaccaucccugaccucaguugagcugccucuggccuuguugcugcugccacauccuaggucuaagaguugaacgccucuccuaggccacuacaaacugaccccucagcagggcuggcugccacagggcugcccugccucauagguagccauggugagggcuaucugcugcaggggggucuuggggagaguggugacuccauugacccagcuuuucauuaaaggauaacacacugcaaaaaaaaaaaaaaaa

SEQ ID NO: 196 - RNA, 5121 nt, Homo_Sapiens
gcgaggaggaaacggugccggagcgcgcagggcuugcugccgccaccgccgcugcacaggcugccggagcgagccugccgcgcgccgcccuccccgcucuccuuccugggcgagcugcggggauggggcggccgcgggagcccgagcgcgcgcaggaaccgccgccgccgccgcccgcgucuccguugccgcgcgccugagccgccgucgccgccgcgcgcccugcccgggggcggcccccccagccccauggaggucucccggaggaaggcgccgccgcgccccccgcgccccgcagcgccacugccccugcucgccuaucugcuggcacuggcggcucccggccggggcgcggacgagcccguguggcggucggagcaagccaucggagccaucgcggcgagccaggaggacggcguguuuguggcgagcggcagcugccuggaccagcuggacuacagccuggagcacagccucucgcgccuguaccgggaccaagcgggcaacugcacagagccggucucgcuggcgccccccgcgcggccccggcccgggagcagcuucagcaagcugcugcugcccuaccgcgagggggcggccggccucggggggcugcugcucaccggcuggaccuucgaccggggcgccugcgaggugcggccccugggcaaccugagccgcaacucccugcgcaacggcaccgagguggugucgugccacccgcagggcucgacggccggcgugguguaccgcgcgggccggaacaaccgcugguaccuggcgguggccgccaccuacgugcugccugagccggagacggcgagccgcugcaaccccgcggcauccgaccacgacacggccaucgcgcucaaggacacggaggggcgcagccuggccacgcaggagcuggggcgccucaagcugugcgagggcgcgggcagccugcacuucguggacgccuuucucuggaacggcagcaucuacuuccccuacuaccccuacaacuauacgagcggcgcugccaccggcuggcccagcauggcgcgcaucgcgcagagcaccgaggugcuguuccagggccaggcaucccucgacugcggccacggccaccccgacggccgccgccugcuccucuccuccagccuaguggaggcccuggacgucugggcgggaguguucagcgcggccgcuggagagggccaggagcggcgcucccccaccaccacggcgcucugccucuucagaaugagugagauccaggcgcgcgccaagagggucagcugggacuucaagacggccgagagccacugcaaagaaggggaucaaccugaaagaguccaaccaaucgcaucaucuaccuugauccauuccgaccugacauccguuuauggcaccgugguaaugaacaggacuguuuuauucuuggggacuggagauggccaguuacuuaagguuauucuuggugagaauuugacuucaaauuguccagagguuaucuaugaaauuaaagaagagacaccuguuuucuacaaacucguuccugauccugugaagaauaucuacauuuaucuaacagcugggaaagaggugaggagaauucguguugcaaacugcaauaaacauaaauccuguucggaguguuuaacagccacagacccucacugcgguuggugccauucgcuacaaaggugcacuuuucaaggagauuguguacauucagagaacuuagaaaacuggcuggauauuucgucuggagcaaaaaagugcccuaaaauucagauaauucgaagcaguaaagaaaagacuacagugacuauggugggaagcuucucuccaagacacucaaagugcauggugaagaauguggacucuagcagggagcucugccagaauaaaagucagcccaaccggaccugcaccuguagcaucccaaccagagcaaccuacaaagauguuucaguugucaacgugauguucuccuucgguucuuggaauuuaucagacagauucaacuuuaccaacugcucaucauuaaaagaaugcccagcaugcguagaaacuggcugcgcgugguguaaaagugcaagaagguguauccaccccuucacagcuugcgacccuucugauuaugagagaaaccaggaacaguguccaguggcugucgagaagacaucaggaggaggaagacccaaggagaacaaggggaacagaaccaaccaggcuuuacaggucuucuacauuaaguccauugagccacagaaaguaucgacauuagggaaaagcaacgugauaguaacgggagcaaacuuuacccgggcaucgaacaucacaaugauccugaaaggaaccaguaccugugauaaggaugugauacagguuagccaugugcuaaaugacacccacaugaaauucucucuuccaucaagccggaaagaaaugaaggauguguguauccaguuugauggugggaacugcucuucugugggauccuuauccuacauugcucugccacauuguucccuuauauuuccugcuaccaccuggaucagugguggucaaaauauaaccaugaugggcagaaauuuugauguaauugacaacuuaaucauuucacaugaauuaaaaggaaacauaaaugucucugaauauuguguggcgacuuacugcggguuuuuagcccccaguuuaaagaguucaaaagugcgcacgaaugucacugugaagcugagaguacaagacaccuacuuggauuguggaacccugcaguaucgggaggaccccagauucacgggguaucggguggaauccgagguggacacagaacuggaagugaaaauucaaaaagaaaaugacaacuucaauauuuccaaaaaagacauugaaauuacucucuuccauggggaaaaugggcaauuaaauugcaguuuugaaaauauuacuagaaaucaagaucuuaccaccauccuuugcaaaauuaaaggcaucaagacugcaagcaccauugccaacucuucuaagaaaguucgggucaagcugggaaaccuggagcucuacgucgagcaggagucaguuccuuccacaugguauuuucugauugugcucccugucuugcuagugauugucauuuuugcggccgugggggugaccaggcacaaaucgaaggagcugagucgcaaacagagucaacaacuagaauugcuggaaagcgagcuccggaaagagauacgugacggcuuugcugagcugcagauggauaaauuggaugugguugauaguuuuggaacuguucccuuccuugacuacaaacauuuugcucugagaacuuucuucccugagucagguggcuucacccacaucuucacugaagauaugcauaacagagacgccaacgacaagaaugaaagucucacagcuuuggaugcccuaaucuguaauaaaagcuuucuuguuacugucauccacacccuugaaaagcagaagaacuuuucugugaaggacaggugucuguuugccuccuuccuaaccauugcacugcaaaccaagcuggucuaccugaccagcauccuagaggugcugaccagggacuugauggaacaguguaguaacaugcagccgaaacucaugcugagacgcacggaguccgucgucgaaaaacuccucacaaacuggauguccgucugccuuucuggauuucuccgggagacugucggagagcccuucuauuugcuggugacgacucugaaccagaaaauuaacaagggucccguggauguaaucacuugcaaagcccuguacacacuuaaugaagacuggcuguuguggcagguuccggaauucaguacuguggcauuaaacgucgucuuugaaaaaaucccggaaaacgagagugcagaugucugucggaauauuucagucaauguucucgacugugacaccauuggccaagccaaagaaaagauuuuccaagcauucuuaagcaaaaauggcucuccuuauggacuucagcuuaaugaaauuggucuugagcuucaaaugggcacacgacagaaagaacuucuggacaucgacaguuccuccgugauucuugaagauggaaucaccaagcuaaacaccauuggccacuaugagauaucaaauggauccacuauaaaagucuuuaagaagauagcaaauuuuacuucagauguggaguacucggaugaccacugccauuugauuuuaccagauucggaagcauuccaagaugugcaaggaaagagacaucgagggaagcacaaguucaaaguaaaagaaauguaucugacaaagcugcugucgaccaagguggcaauucauucugugcuugaaaaacuuuuuagaagcauuuggaguuuacccaacagcagagcuccauuugcuauaaaauacuuuuuugacuuuuuggacgcccaggcugaaaacaaaaaaaucacagauccugacgucguacauauuuggaaaacaaacagccuuccucuucgcuucuggguaaacauccugaagaacccucaguuugucuuugacauuaagaagacaccacauauagacggcuguuugucagugauugcccaggcauucauggaugcauuuucucucacagagcagcaacuagggaaggaagcaccaacuaauaagcuucucuaugccaaggauaucccaaccuacaaagaagaaguaaaaucuuauuacaaagcaaucagggauuugccuccauugucauccucagaaauggaagaauuuuuaacucaggaaucuaagaaacaugaaaaugaauuuaaugaagaaguggccuugacagaaauuuacaaauacaucguaaaauauuuugaugagauucuaaauaaacuagaaagagaacgagggcuggaagaagcucagaaacaacucuugcauguaaaagucuuauuugaugaaaagaagaaaugcaaguggauguaagcacucuggggccuggcuuaaucuggcaaaguucuucagacgacuugggagcaaaauggcugcuugagcuacucugugucguuaauuuguuguuugcacauagguuccacuuugggcacugucuuuuuaagagaccaaggcacaugcacagcuuuuagaaagcaa

SEQ ID NO: 197 - RNA, 1485 nt, Homo_Sapiens
ggaccugcagccucccagguggcugggaagaacucuccaacaauaaauacauuugauaagaaagauggcuuuaaaagugcuacuagaacaagagaaaacguuuuucacucuuuuaguauuacuaggcuauuugucauguaaagugacuugugaaucaggagacuguagacagcaagaauucagggaucggucuggaaacuguguucccugcaaccagugugggccaggcauggaguugucuaaggaauguggcuucggcuauggggaggaugcacagugugugacgugccggcugcacagguucaaggaggacuggggcuuccagaaaugcaagcccugucuggacugcgcaguggugaaccgcuuucagaaggcaaauuguucagccaccagugaugccaucugcggggacugcuugccaggauuuuauaggaagacgaaacuugucggcuuucaagacauggagugugugccuuguggagacccuccuccuccuuacgaaccgcacugugccagcaaggucaaccucgugaagaucgcguccacggccuccagcccacgggacacggcgcuggcugccguuaucugcagcgcucuggccaccguccugcuggcccugcucauccucugugucaucuauuguaagagacaguuuauggagaagaaacccagcuggucucugcggucacaggacauucaguacaacggcucugagcugucguguuuugacagaccucagcuccacgaauaugcccacagagccugcugccagugccgccgugacucagugcagaccugcgggccggugcgcuugcucccauccaugugcugugaggaggccugcagccccaacccggcgacucuugguuguggggugcauucugcagccagucuucaggcaagaaacgcaggcccagccggggagauggugccgacuuucuucggaucccucacgcaguccaucuguggcgaguuuucagaugccuggccucugaugcagaaucccauggguggugacaacaucucuuuuugugacucuuauccugaacucacuggagaagacauucauucucucaauccagaacuugaaagcucaacgucuuuggauucaaauagcagucaagauuugguugguggggcuguuccaguccagucucauucugaaaacuuuacagcagcuacugauuuaucuagauauaacaacacacugguagaaucagcaucaacucaggaugcacuaacuaugagaagccagcuagaucaggagaguggugcugucauccacccagccacucagacgucccuccagguaaggcagcgacuggguucccugugaacacagcacugacuuacaguagaucagaacucuguucccagcauaagauuugggggaaccugaugaguuuuuuuuuugcaucuuuaauaauuucuuguauguuguagaguauguuuuaaaauaaauuucaaguauuuuuuuaaaaaacu

SEQ ID NO: 198 - RNA, 4283 nt, Homo_Sapiens
gggaggguaacuaccugcugaaagugaacuuucuuugauauccaugcauauauauaaacucagcccugccuuugauguucagcaacugauucacugaucagauuacaggcauuucaucucccugcucgucugccuuugaucugcaugguuaauuuuauuuuccuggauuugaaguuucgucugggcuugugcugacauacauuuuugggaagguagaagcauuuggcacagaagugcugccaggagaaacuaaguugcugaacggaacucuccaacaauaaauacauuugauaagaaagauggcuuuaaaagugcuacuagaacaagagaaaacguuuuucacucuuuuaguauuacuaggcuauuugucauguaaagugacuugugaaucaggagacuguagacagcaagaauucagggaucggucuggaaacuguguucccugcaaccagugugggccaggcauggaguugucuaaggaauguggcuucggcuauggggaggaugcacagugugugacgugccggcugcacagguucaaggaggacuggggcuuccagaaaugcaagcccugucuggacugcgcaguggugaaccgcuuucagaaggcaaauuguucagccaccagugaugccaucugcggggacugcuugccaggauuuuauaggaagacgaaacuugucggcuuucaagacauggagugugugccuuguggagacccuccuccuccuuacgaaccgcacugugccagcaaggucaaccucgugaagaucgcguccacggccuccagcccacgggacacggcgcuggcugccguuaucugcagcgcucuggccaccguccugcuggcccugcucauccucugugucaucuauuguaagagacaguuuauggagaagaaacccagcuggucucugcggucacaggacauucaguacaacggcucugagcugucguguuuugacagaccucagcuccacgaauaugcccacagagccugcugccagugccgccgugacucagugcagaccugcgggccggugcgcuugcucccauccaugugcugugaggaggccugcagccccaacccggcgacucuugguuguggggugcauucugcagccagucuucaggcaagaaacgcaggcccagccggggagauggugccgacuuucuucggaucccucacgcaguccaucuguggcgaguuuucagaugccuggccucugaugcagaaucccauggguggugacaacaucucuuuuugugacucuuauccugaacucacuggagaagacauucauucucucaauccagaacuugaaagcucaacgucuuuggauucaaauagcagucaagauuugguugguggggcuguuccaguccagucucauucugaaaacuuuacagcagcuacugauuuaucuagauauaacaacacacugguagaaucagcaucaacucaggaugcacuaacuaugagaagccagcuagaucaggagaguggugcugucauccacccagccacucagacgucccuccaggaagcuuaaagaaccugcuucuuucugcaguagaagcgugugcuggaacccaaagaguacuccuuuguuaggcuuauggacugagcagucuggaccuugcauggcuucuggggcaaaaauaaaucugaaccaaacugacggcauuugaagccuuucagccaguugcuucugagccagaccagcuguaagcugaaaccucaaugaauaacaagaaaagacuccaggccgacucaugauacucugcaucuuuccuacaugagaagcuucucugccacaaaagugacuucaaagacggauggguugagcuggcagccuaugagauuguggacauauaacaagaaacagaaaugcccucaugcuuauuuucauggugauugugguuuuacaagacugaagacccagaguauacuuuuucuuuccagaaauaauuucauaccgccuaugaaauaucagauaaauuaccuuagcuuuuauguagaauggguucaaaagugaguguuucuauuugagaaggacacuuuuucaucaucuaaacugauucgcauaggugguuagaauggcccucauauugccugccuaaaucuuggguuuauuagaugaaguuuacugaaucagaggaaucagacagaggaggauagcucuuuccagaauccacacuucugaccucagccucggucucaugaacacccgcugaucucaggagaacaccugggcuagggaauguggucgagaaagggcagcccauugcccagaauuaacacauauuguagagacuuguaugcaaagguuggcauauuuauaugaaaauuaguugcuauagaaacauuuguugcaucugucccucugccugagcuuagaagguuauagaaaaaggguauuuauaaacauaaaugaccuuuuacuugcauuguaucuuauacuaaaggcuuuagaaauuacaacauaucagguuccccuacuacugaaguagccuuccgugagaacacaccacauguuaggacuagaagaaaaugcacaauuuguagggguuuggaugaagcagcuguaacugcccuaguguaguuugaccaggacauugucgugcuccuuccaauuguguaagauuaguuagcacaucaucuccuacuuuagccauccgguguuggauuuaagaggacggugcuucuuucuauuaaagugcuccauccccuaccaucuacacauuagcauugucucuagagcuaagacagaaauuaaccccguucagucacaaagcagggaaugguucauuuacucuuaaucuuuaugcccuggagaagaccuacuugaacagggcauauuuuuuagacuucugaacaucaguauguucgaggguacuaugauauuuugguuuggaauugcccugcccaagucacugucuuuuaacuuuuaaacugaauauuaaaauguaucugucuuuccuaguauguuuuuaucuucucauguauuauccaugguuuucucuguuugugacagauuaguaaaauuuaaugagcccucuuucuuguggccguuucuccauaguuuuagguuuugauauguguuuacuagcuugccugugucugguacaucucaugaccucaauucccucaccugaaauaggaaaugagaauguuucauuguagccccaagcggucaugucaaccuagugccuagucauaauuaauugacuuuuccuguauuacuucuuuuuuuaaguauaaaccaaugauccuuugguagucaagaacucuuaggaacauugccuuuuggacauguaaaauauuuaggauuugaccacacaauggcuaugaaaaugcaaguaguuuccucgcgugaccucaccaugauucacauacgugccacuguuugaaaucuggucuguuugcauuucuguuaugacagagagaugauguuugcauuucuguuaugacagagagaugaugaaaguaggcagggcuguguuccuuuguguagccuguauauauuuuccauauguagagcccugauuaacuucaaggacaaacacuggcuggagaaagccagacugaugggaaugagacuuuggccaaaaaucccaaaacaucauuuucaaucaguagagaagugcuuaggguugaaaauugauuucauuugcuacugaauuugguaaauccuggguaacuuuuaucaagaugaagacauuuuacccuaccuacucuagaaauauacaacaauguuauauuuuacacuccuuggaaacauuugaggaaaaaaaugcaauuugcacuucacuuuguuggaauaucccauagcacucaauaaacucagcugcuagagugccgaugucaggagggcugugucggguaaugcguguggcugaaugggcauaaccacuguggcuucuugugcugcagaagcucguugacaagacugaggaggauuucaagagcaaccaaguaaagucaugaauuuucuaauuuuguguauauggaauauauuuuuaaauagagauuuuucuacuuuagauaauguguuaauauugcuauuaccuagguuaagcacuauugucugugcuaguaagaaaaagaaaggaaaaccaucauugcuuuauaguagcuuauaucaauuuagauuucaucauuacuauuuugcauacuggaauuuauaaauguguaaauuaucauuuucuuaguuuuguaauaccuuuuuuauuugugaauaaaauuaucaccugguauucuuaaaaaaaaaaaaaaaaaa

SEQ ID NO: 199 - RNA, 2250 nt, Homo_Sapiens
gaaggaagccaagagccuauaauagcgauccuggggaaaauuucagcagcuggggccauguaauuuaaaaccucugaaaagugugcugcgguccgugcacagcauuaguauaacgugagggcugaaugcagcccauucucuggagaacuuccucacacaccgcagcaaagagaagacugaaagacaaaccugggugcagccagagagguccagauagaugagcuuguggcauccauuccccaaguucagccuagggacuccacguaccccagcugggucucauuguuccagaacugcauuaguuaagauuacccagacuuggauuucaaaggaauacuuucauuguuccgucuguaacacgaaguaauuggggccagcuggaugucaggaugcgugugguuaccauuguaaucuugcucugcuuuugcaaagcggcugagcugcgcaaagcaagcccaggcagugugagaagccgagugaaucauggccgggcggguggaggccggagaggcuccaacccggucaaacgcuacgcaccaggccucccgugugacguguacacauaucuccaugagaaauacuuagauugucaagaaagaaaauuaguuuaugugcugccugguuggccucaggauuugcugcacaugcugcuagcaagaaacaagauccgcacauugaagaacaacauguuuuccaaguuuaaaaagcugaaaagccuggaucugcagcagaaugagaucucuaaaauugagagugaggcguucuuugguuuaaacaaacucaccacccucuuacugcagcacaaccagaucaaagucuugacggaggaaguguucauuuacacaccucucuugagcuaccugcgucuuuaugacaaccccuggcacuguacuugugagauagaaacgcuuauuucaauguugcagauucccaggaaccggaauuuggggaacuacgccaagugugaaaguccacaagaacaaaaaaauaaaaaacugcggcagauaaaaucugaacaguuguguaaugaagaagaaaaggaacaauuggacccgaaaccccaagugucagggagacccccagucaucaagccugagguggacucaacuuuuugccacaauuauguguuucccauacaaacacuggacugcaaaaggaaagaguugaaaaaagugccaaacaacaucccuccagauauuguuaaacuugacuugucauacaauaaaaucaaccaacuucgacccaaggaauuugaagauguucaugagcugaagaaauuaaaccucagcagcaauggcauugaauucaucgauccugccgcuuuuuuagggcucacacauuuagaagaauuagauuuaucaaacaacagucugcaaaacuuugacuauggcguauuagaagacuuguauuuuuugaaacucuuguggcucagagauaacccuuggagaugugacuacaacauucacuaccucuacuacugguuaaagcaccacuacaauguccauuuuaauggccuggaaugcaaaacgccugaagaauacaaaggauggucugugggaaaauauauuagaaguuacuaugaagaaugccccaaagacaaguuaccagcauauccugagucauuugaccaagacacagaagaugaugaaugggaaaaaaaacauagagaucacaccgcaaagaagcaaagcguaauaauuacuauaguaggauaagguagaaauuguucugauuguaauuaguuuuguauuuucuauacugguguuagaaaacauauguuuacauuugauuaacuguguugccuauuuaugcaggguaauccagcuaaaggaagcuuucuuuaauuauaaguauuauugugacuauuauaguaaucaagagaaugcuaucauccugcuugccuguccauuuguggaacagcaucuggugauaugcaauuccacacugguaaccugcagcaguuggguccuaaugauggcauuagacuuucauaauguccuguauaaauguuuuuacugcuuuuagaaaauaaagaaaaaaaacuugguucauguuuacaugccuuucgauagcuguuugugcauacuuaaagaugaucaaaaugauuuuauacaaaugcuguuauaauaaaaugucauucccuaccccucuacuuuuuuucaguaagucaucuuauacauuaaauaaauuuccauuucugauuucugugcauuccaaaaaaaaaaaaaaaaaaaaaaaaaaaaaaaaaaa

SEQ ID NO: 200 - RNA, 2303 nt, Homo_Sapiens
gaaggaagccaagagccuauaauagcgauccuggggaaaauuucagcagcuggggccauguaauuuaaaaccucugaaaagugugcugcgguccgugcacagcauuaguauaacgugagggcugaaugcagcccauucucuggagaacuuccucacacaccgcagcaaagagaagacugaaagacaaaccugggugcagccagagagguccagauagaugagcuuguggcauccauuccccaaguucagccuagggacuccacguaccccagcugggucucauuguuccagaacugcauuaguuaagauuacccagacuuggauuucaaaggaauacuuucauuguuccgucuguaacacgaaguaauuggggccagcuggaugucaggaugcgugugguuaccauuguaaucuugcucugcuuuugcaaagcggcugagcugcgcaaagcaagcccaggcagugugagaagccgagugaaucauggccgggcggguggaggccggagaggcuccaacccggucaaacgcuacgcaccaggccucccgugugacguguacacauaucuccaugagaaauacuuagauugucaagaaagaaaauuaguuuaugugcugccugguuggccucaggauuugcugcacaugcugcuagcaagaaacaagauccgcacauugaagaacaacauguuuuccaaguuuaaaaagcugaaaagccuggaucugcagcagaaugagaucucuaaaauugagagugaggcguucuuugguuuaaacaaacucaccacccucuuacugcagcacaaccagaucaaagucuugacggaggaaguguucauuuacacaccucucuugagcuaccugcgucuuuaugacaaccccuggcacuguacuugugagauagaaacgcuuauuucaauguugcagauucccaggaaccggaauuuggggaacuacgccaagugugaaaguccacaagaacaaaaaaauaaaaaacugcggcagauaaaaucugaacaguuguguaaugaagaagaaaaggaacaauuggacccgaaaccccaagugucagggagacccccagucaucaagccugagguggacucaacuuuuugccacaauuauguguuucccauacaaacacuggacugcaaaaggaaagaguugaaaaaagugccaaacaacaucccuccagauauuguuaaacuugacuugucauacaauaaaaucaaccaacuucgacccaaggaauuugaagauguucaugagcugaagaaauuaaaccucagcagcaauggcauugaauucaucgauccugggucuuugagaugaaacccugcaaguagacuuacgugaaugauuuuugcugugccgcuuuuuuagggcucacacauuuagaagaauuagauuuaucaaacaacagucugcaaaacuuugacuauggcguauuagaagacuuguauuuuuugaaacucuuguggcucagagauaacccuuggagaugugacuacaacauucacuaccucuacuacugguuaaagcaccacuacaauguccauuuuaauggccuggaaugcaaaacgccugaagaauacaaaggauggucugugggaaaauauauuagaaguuacuaugaagaaugccccaaagacaaguuaccagcauauccugagucauuugaccaagacacagaagaugaugaaugggaaaaaaaacauagagaucacaccgcaaagaagcaaagcguaauaauuacuauaguaggauaagguagaaauuguucugauuguaauuaguuuuguauuuucuauacugguguuagaaaacauauguuuacauuugauuaacuguguugccuauuuaugcaggguaauccagcuaaaggaagcuuucuuuaauuauaaguauuauugugacuauuauaguaaucaagagaaugcuaucauccugcuugccuguccauuuguggaacagcaucuggugauaugcaauuccacacugguaaccugcagcaguuggguccuaaugauggcauuagacuuucauaauguccuguauaaauguuuuuacugcuuuuagaaaauaaagaaaaaaaacuugguucauguuuacaugccuuucgauagcuguuugugcauacuuaaagaugaucaaaaugauuuuauacaaaugcuguuauaauaaaaugucauucccuaccccucuacuuuuuuucaguaagucaucuuauacauuaaauaaauuuccauuucugauuucugugcauuccaaaaaaaaaaaaaaaaaaaaaaaaaaaaaaaaaaa

SEQ ID NO: 201 - RNA, 6650 nt, Homo_Sapiens
gcugguuccccuuccgagcguccgcgccccgcaugcgcagucugccccggcggucuccguuuguuugaacaggaaggcggacauauuagucccucucagccccccucgccccaccccccaggcauucgccgccgcgacucgcccuuuccccggcugggaccgcagccccucccagaagcucccccaucagcagccgccgggacccaacuaucgucuuccucuucgcccgcucuccagccuuuccucugcuaagucuccaucgggcaucgaccucgcccugccccaccggacaccguagcagcagccccagcagcgacgggacaaaaugggagagugaggcuguccugcguggaccagcucguggccgagacugaucggugcgucgggccgggccgaguagagccggggacgcggggcuagaccgucuacagcgccucugagcggagcgggcccggcccguggcccgagcggcggccgcagcuggcacagcuccucacccgcccuuugcuuucgccuuuccucuucucccucccuuguugcccggagggagucuccacccugcuucucuuucucuacccgcuccugcccaucucgggacggggaccccuccauggcgacggcggccggggcccgcuagacugaagcaccucgccggagcgacgaggcugguggcgacggcgcugucggcugucgugaggggcugccgggugggaugcgacuuugggcguccgagcggcugugggucgcuguugcccccggcccggggucuggagagcggagguccccucagugaggggaagacgggggaaccgggcgcaccuggugacccugagguuccggcuccuccgccccgcggcugcgaacccaccgcggaggaaguugguugaaauugcuuuccgcugcuggugcugguaagagggcauugucacagcagcagcaacaugucgacuggggacaguuuugagacucgauuugaaaaaauggacaaccugcugcgggaucccaaaucggaagugaauucggauuguuugcuggauggauuggaugcuuugguauaugauuuggauuuuccugccuuaagaaaaaacaaaaauauugacaacuuuuuaagcagauauaaagacacaauaaauaaaaucagagauuuacgaaugaaagcugaagauuaugaaguagugaaggugauugguagaggugcauuuggagaaguucaauugguaaggcauaaauccaccaggaagguauaugcuaugaagcuucucagcaaauuugaaaugauaaagagaucugauucugcuuuuuucugggaagaaagggacaucauggcuuuugccaacaguccuuggguuguucagcuuuuuuaugcauuccaagaugaucguuaucucuacauggugauggaauacaugccugguggagaucuuguaaacuuaaugagcaacuaugaugugccugaaaaaugggcacgauucuauacugcagaaguaguucuugcauuggaugcaauccauuccauggguuuuauucacagagaugugaagccugauaacaugcugcuggauaaaucuggacauuugaaguuagcagauuuugguacuuguaugaagaugaauaaggaaggcaugguacgaugugauacagcgguuggaacaccugauuauauuuccccugaaguauuaaaaucccaagguggugaugguuauuauggaagagaaugugacugguggucgguugggguauuuuuauacgaaaugcuuguaggugauacaccuuuuuaugcagauucuuugguuggaacuuacaguaaaauuaugaaccauaaaaauucacuuaccuuuccugaugauaaugacauaucaaaagaagcaaaaaaccuuauuugugccuuccuuacugacagggaagugagguuagggcgaaaugguguagaagaaaucaaacgacaucucuucuucaaaaaugaccagugggcuugggaaacgcuccgagacacuguagcaccaguuguacccgauuuaaguagugacauugauacuaguaauuuugaugacuuggaagaagauaaaggagaggaagaaacauucccuauuccuaaagcuuucguuggcaaucaacuaccuuuuguaggauuuacauauuauagcaaucguagauacuuaucuucagcaaauccuaaugauaacagaacuagcuccaaugcagauaaaagcuugcaggaaaguuugcaaaaaacaaucuauaagcuggaagaacagcugcauaaugaaaugcaguuaaaagaugaaauggagcagaagugcagaaccucaaacauaaaacuagacaagauaaugaaagaauuggaugaagagggaaaucaaagaagaaaucuagaaucuacagugucucagauugagaaggagaaaauguugcuacagcauagaauuaaugaguaccaaagaaaagcugaacaggaaaaugagaagagaagaaauguagaaaaugaaguuucuacauuaaaggaucaguuggaagacuuaaagaaagucagucagaauucacagcuugcuaaugagaagcugucccaguuacaaaagcagcuagaagaagccaaugacuuacuuaggacagaaucggacacagcuguaagauugaggaagagucacacagagaugagcaagucaauuagucaguuagagucccugaacagagaguugcaagagagaaaucgaauuuuagagaauucuaagucacaaacagacaaagauuauuaccagcugcaagcuauauuagaagcugaacgaagagacagaggucaugauucugagaugauuggagaccuucaagcucgaauuacaucuuuacaagaggaggugaagcaucucaaacauaaucucgaaaaaguggaaggagaaagaaaagaggcucaagacaugcuuaaucacucagaaaaggaaaagaauaauuuagagauagauuuaaacuacaaacuuaaaucauuacaacaacgguuagaacaagagguaaaugaacacaaaguaaccaaagcucguuuaacugacaaacaucaaucuauugaagaggcaaagucuguggcaaugugugagauggaaaaaaagcugaaagaagaaagagaagcucgagagaaggcugaaaaucggguuguucagauugagaaacaguguuccaugcuagacguugaucugaagcaaucucagcagaaacuagaacauuugacuggaaauaaagaaaggauggaggaugaaguuaagaaucuaacccugcaacuggagcaggaaucaaauaagcggcuguuguuacaaaaugaauugaagacucaagcauuugaggcagacaauuuaaaagguuuagaaaagcagaugaaacaggaaauaaauacuuuauuggaagcaaagagauuauuagaauuugaguuagcucagcuuacgaaacaguauagaggaaaugaaggacagaugcgggagcuacaagaucagcuugaagcugagcaauauuucucgacacuuuauaaaacccagguaaaggaacuuaaagaagaaauugaagaaaaaaacagagaaaauuuaaagaaaauacaggaacuacaaaaugaaaaagaaacucuugcuacucaguuggaucuagcagaaacaaaagcugagucugagcaguuggcgcgaggccuucuggaagaacaguauuuugaauugacgcaagaaagcaagaaagcugcuucaagaaauagacaagagauuacagauaaagaucacacuguuagucggcuugaagaagcaaacagcaugcuaaccaaagauauugaaauauuaagaagagagaaugaagagcuaacagagaaaaugaagaaggcagaggaagaauauaaacuggagaaggaggaggagaucaguaaucuuaaggcugccuuugaaaagaauaucaacacugaacgaacccuuaaaacacaggcuguuaacaaauuggcagaaauaaugaaucgaaaagauuuuaaaauugauagaaagaaagcuaauacacaagauuugagaaagaaagaaaaggaaaaucgaaagcugcaacuggaacucaaccaagaaagagagaaauucaaccagaugguagugaaacaucagaaggaacugaaugacaugcaagcgcaauugguagaagaaugugcacauaggaaugagcuucagaugcaguuggccagcaaagagagugauauugagcaauugcgugcuaaacuuuuggaccucucggauucuacaaguguugcuaguuuuccuagugcugaugaaacugaugguaaccucccagagucaagaauugaagguuggcuuucaguaccaaauagaggaaauaucaaacgauauggcuggaagaaacaguauguugugguaagcagcaaaaaaauuuuguucuauaaugacgaacaagauaaggagcaauccaauccaucuaugguauuggacauagauaaacuguuucacguuagaccuguaacccaaggagauguguauagagcugaaacugaagaaauuccuaaaauauuccagauacuauaugcaaaugaaggugaauguagaaaagauguagagauggaaccaguacaacaagcugaaaaaacuaauuuccaaaaucacaaaggccaugaguuuauuccuacacucuaccacuuuccugccaauugugaugccugugccaaaccucucuggcauguuuuuaagccacccccugcccuagagugucgaagaugccauguuaagugccacagagaucacuuagauaagaaagaggacuuaauuuguccauguaaaguaaguuaugauguaacaucagcaagagauaugcugcuguuagcauguucucaggaugaacaaaaaaaauggguaacucauuuaguaaagaaaaucccuaagaauccaccaucugguuuuguucgugcuuccccucgaacgcuuucuacaagauccacugcaaaucagucuuuccggaaaguggucaaaaauacaucuggaaaaacuaguuaaccaugugacugagugcccuguggaaucgugugggaugcuaccugauaaaccaggcuucuuuaaccaugcagagcagacaggcuguuucuuugacacaaauaucacaggcuucaggguuaagauugcuguuuuucuguccuugcuuuggcacaacacacugaggguuuuuuuuauugcggguuugccuacagguagauuagauuaauuauuacuauguaaugcaaguacaguugggggaaagcuuagguagauauauuuuuuuuaaaaggugcugccuuuuuggauuuauaagaaaaugccugucagucgugauagaacagaguuuuccucauaugaguaagaggaagggacuuucacuuucaaguggaacagccaucacuaucaagaucagcucauggaaggaguaaagaaaauaucucaaaaugagacaaacugaaguuuuguuuuuuuuuuaaugacuuaaguuuuugugcucuugcaagacuauacaaaacuauuuuaagaaagcagugauaucacuugaacuucagugcccucacuguagaauuuaaaagccuuacuguugauugcccauguuggacuugauggagaaauuaaauaucuuucauuaugcuuuacaaaauacuguauauguuucagcaaguuuggggaaugggagaggacaaaaaaaaguuacauuuaaucuaugcauuuuugccaagccauauugaguuauuuuacuacuagagacauuaggaaacuaacuguacaaaagaaccaaguuuaaaagcauuuugugggguacaucauuucuauaauuguauaauguauuucuuugugguuuuaaaugauaaagacauuaaguuaacaaacauauaagaaauguaugcacuguuugaaauguaaauuauucuuagaacacuuucaauggggguugcauuguccuuuuagugccuuaauuugagauaauuauuuuacugccaugaguaaguauagaaauuucaaaaaauguauuuucaaaaaauuaugugugucagugaguuuuucauugauaauugguuuaauuuaaaauauuuagagguuuguuggacuuucauaaauugaguacaaucuuugcaucaaacuaccugcuacaauaaugacuuuauaaaacugcaaaaaauguagaagguugcaccaacauaaaaaggaaauauggcaauacauccaugauguuuuccaguuaacauaggaauuaccagauaaauacuguuaaacucuuguccaguaacaagaguugauucauauggacaguaugauuuauuguuuauuuuuuuaaccaaauaccuccucaguaauuuauaauggcuuugcaguaauguguaucagauaagaagcacuggaaaaccgaucgucucuaggaugauaugcauguuucaagugguauugaaagccgcacugauggauauguaauaauaaacauaucuguuauuaauauacuaaugacucugugcucauuuaaugagaaauaaaaguaauuuauggauggguaucuuuaauuuuuacugcaauguguuuucucauggcugaaaugaauggaaaacauacuucaaauuagucucugauuguauauaaauguuugugaaauuccaugguuagauuaaaguguauuuuuaaaagauaaaa

SEQ ID NO: 202 - RNA, 3332 nt, Homo_Sapiens
gcgccgagccgguuuccccgccgguguccgagaggcgcccccggcccggcccggcccggcccgcgcccuccgcccccgccuccccgggccggcggcggugggcgagcucgcgggcccggccgcccccagccccagccccgccgggccccgccccccgucgagugcaugagguugacgcuacuuuguugcaccuggagggaagaacguaugggagaggaaggaagcgaguugcccgugugugcaagcugcggccagaggaucuaugauggccaguaccuccaggcccugaacgcggacuggcacgcagacugcuucagguguugugacugcagugccucccugucgcaccaguacuaugagaaggaugggcagcucuucugcaagaaggacuacugggcccgcuauggcgaguccugccaugggugcucugagcaaaucaccaagggacugguuaugguggcuggggagcugaaguaccaccccgaguguuucaucugccucacgugugggaccuuuaucggugacggggacaccuacacgcugguggagcacuccaagcuguacugcgggcacugcuacuaccagacuguggugacccccgucaucgagcagauccugccugacuccccuggcucccaccugccccacaccgucacccugguguccaucccagccucaucucauggcaagcguggacuuucagucuccauugaccccccgcacggcccaccgggcuguggcaccgagcacucacacaccguccgcguccagggaguggauccgggcugcaugagcccagaugugaagaauuccauccacgucggagaccggaucuuggaaaucaauggcacgcccauccgaaaugugccccuggacgagauugaccugcugauucaggaaaccagccgccugcuccagcugacccucgagcaugacccucacgauacacugggccacgggcuggggccugagaccagcccccugagcucuccggcuuauacucccagcggggaggcgggcagcucugcccggcagaaaccugucuugaggagcugcagcaucgacaggucuccgggcgcuggcucacugggcuccccggccucccagcgcaaggaccugggucgcucugagucccuccgcguagucugccggccacaccgcaucuuccggccgucggaccucauccacggggaggugcugggcaagggcugcuucggccaggcuaucaaggugacacaccgugagacaggugaggugauggugaugaaggagcugauccgguucgacgaggagacccagaggacguuccucaaggaggugaaggucaugcgaugccuggaacaccccaacgugcucaaguucaucggggugcucuacaaggacaagaggcucaacuucaucacugaguacaucaagggcggcacgcuccggggcaucaucaagagcauggacagccaguacccauggagccagagagugagcuuugccaaggacaucgcaucagggauggccuaccuccacuccaugaacaucauccaccgagaccucaacucccacaacugccugguccgcgagaacaagaauguggugguggcugacuucgggcuggcgcgucucaugguggacgagaagacucagccugagggccugcggagccucaagaagccagaccgcaagaagcgcuacaccguggugggcaaccccuacuggauggcaccugagaugaucaacggccgcagcuaugaugagaagguggauguguucuccuuugggaucguccugugcgagaucaucgggcgggugaacgcagacccugacuaccugccccgcaccauggacuuuggccucaacgugcgaggauuccuggaccgcuacugccccccaaacugccccccgagcuucuuccccaucaccgugcgcuguugcgaucuggaccccgagaagaggccauccuuugugaagcuggaacacuggcuggagacccuccgcaugcaccuggccggccaccugccacugggcccacagcuggagcagcuggacagagguuucugggagaccuaccggcgcggcgagagcggacugccugcccacccugagguccccgacugagccagggccacucagcugccccuguccccaccucuggagaauccacccccaccagauuccuccgcgggagguggcccucagcugggacaguggggacccaggcuucuccucagagccaggcccugacuugccuucucccaccccguggaccgcuuccccugccuucucucugccguggcccagagccggcccagcugcacacacacaccaugcucucgcccugcuguaaccucugucuuggcagggcuguccccucuugcuucuccuugcaugagcuggagggccugugugaguuacgccccuuuccacacgccgcugccccagcaacccuguucacgcuccaccugucugguccauagcucccuggaggcugggccaggaggcagccuccgaaccaugccccauauaacgcuugggugcgugggagggcgcacaucagggcagaggccaaguuccaggugucuguguucccaggaaccaaauggggagucuggggcccguuuuccccccagggggugucuagguagcaacagguaucgaggacucuccaaacccccaaagcagagagagggcugaucccauggggcggagguccccaguggcugagcaaacagccccuucucucgcuuugggucuuuuuuuuguuucuuucuuaaagccacuuuagugagaagcagguaccaagccucagggugaagggggucccuugagggagcguggagcugcggugcccuggccggcgauggggaggagccggcuccggcagugagaggauaggcacaguggaccgggcagguguccaccagcagcucagccccugcagucaucucagagccccuucccgggccucucccccaaggcucccugccccuccucaugccccucuguccucugcguuuuuucuguguaaucuauuuuuuaagaagaguuuguauuauuuuuucauacggcugcagcagcagcugccaggggcuugggauuuuauuuuuguggcgggcgggggugggagggccauuuugucacuuugccucaguugagcaucuaggaaguauuaaaacugugaagcuuucucagugcacuuugaaccuggaaaacaaucccaacaggcccgugggaccaugacuuagggaggugggacccacccacccccauccaggaaccgugacguccaaggaaccaaacccagacgcagaacaauaaaauaaauuccguacuccccaccc

SEQ ID NO: 203 - RNA, 2914 nt, Homo_Sapiens
ugacagcagcgcuucuuucuuagcuagucaccggccccugcucaagaaugccaguguguguguagccuccacagagaggucguuuucucggaguccagaggggccgccugagcuucugagaacuagggaggagccaucccagccaugagccccugugggaaucugcugggggccaaguggccuggaguccucaggcucccgcagcugcuccggagggagaggugagcucagggcagccugccugcagccagaggugccgggagccccgggccugucaugguggccaucuacagccggccugaggcagucacagacggauuugcagcugagccugucuaucuggugugggaagaagauggggaguuacuugucagucccggcuuacuucaccuccagagaccuguuucgguguucagaaugccaggauucccucaccaacugguacuaugagaaggaugggaagcucuacugccccaaggacuacugggggaaguuuggggaguucugucaugggugcucccugcugaugacagggccuuuuaugguggcuggggaguucaaguaccacccagagugcuuugccuguaugagcugcaaggugaucauugaggauggggaugcauaugcacuggugcagcaugccacccucuacugugggaagugccacaaugagguggugcuggcacccauguuugagagacucuccacagagucuguucaggagcagcugcccuacucugucacgcucaucuccaugccggccaccacugaaggcaggcggggcuucuccguguccguggagagugccugcuccaacuacgccaccacugugcaagugaaagaggucaaccggaugcacaucagucccaacaaucgaaacgccauccacccuggggaccgcauccuggagaucaaugggacccccguccgcacacuucgaguggaggagguggaggaugcaauuagccagacgagccagacacuucagcuguugauugaacaugaccccgucucccaacgccuggaccagcugcggcuggaggcccggcucgcuccucacaugcagaaugccggacacccccacgcccucagcacccuggacaccaaggagaaucuggaggggacacugaggagacguucccuaaggcgcaguaacaguaucuccaaguccccuggccccagcuccccaaaggagccccugcuguucagccgugacaucagccgcucagaaucccuucguuguuccagcagcuauucacagcagaucuuccggcccugugaccuaauccauggggagguccuggggaagggcuucuuugggcaggcuaucaaggugacacacaaagccacgggcaaagugauggucaugaaagaguuaauucgaugugaugaggagacccagaaaacuuuucugacugaggugaaagugaugcgcagccuggaccaccccaaugugcucaaguucauuggugugcuguacaaggauaagaagcugaaccuccugacagaguacauugaggggggcacacugaaggacuuucugcgcaguauggauccguuccccuggcagcagaaggucagguuugccaaaggaaucgccuccggaauggccuauuugcacucuaugugcaucauccaccgggaucugaacucgcacaacugccucaucaaguuggacaagacuguggugguggcagacuuugggcugucacggcucauaguggaagagaggaaaagggcccccauggagaaggccaccaccaagaaacgcaccuugcgcaagaacgaccgcaagaagcgcuacacgguggugggaaaccccuacuggauggccccugagaugcugaacggaaagagcuaugaugagacgguggauaucuucuccuuugggaucguucucugugagaucauugggcagguguaugcagauccugacugccuuccccgaacacuggacuuuggccucaacgugaagcuuuucugggagaaguuuguucccacagauugucccccggccuucuucccgcuggccgccaucugcugcagacuggagccugagagcagagccccccccggggccgcaggagagggcccgggcugcgcggaugaugagggcccagugaggcgccaagggaaggucaccaucaaguaugaccccaaggagcuacggaagcaccucaaccuagaggaguggauccuggagcagcucacgcgccucuacgacugccaggaagaggagaucucagaacuagagauugacguggaugagcuccuggacauggagagugacgaugccugggcuuccagggucaaggagcugcugguugacuguuacaaacccacagaggccuucaucucuggccugcuggacaagauccgggccaugcagaagcugagcacaccccagaagaagugaggguccccgacccaggcgaacgguggcucccauaggacaaucgcuaccccccgaccucguagcaacagcaauaccgggggacccugcggccaggccugguuccaugagcagggcuccucgugccccuggcccaggggucucuuccccugcccccucaguuuuccacuuuuggauuuuuuuauuguuauuaaacugaugggacuuuguguuuuuauauugacucugcggcacgggcccuuuaauaaagcgagguaggguacgccuuuggugcagcucaaaaaaaaaaaaaaaaaugauuuccagcgguccacauuagaguugaaauuuucuggugggagaaucuauaccuuguuccuuuauaggccaaggaccgcaguccuucaguaacaccaguguaaaagcuugaggagaaauugugaagcuacacaguauuuguuuucuaauaccucuugucauucuaaauaucuuuaauuuauuaaaaaauauauauauacagua

SEQ ID NO: 204 - RNA, 3701 nt, Homo_Sapiens
uaggcggugcaucccguucgcgccuggggcuguggucuucccgcgccugaggcggcggcggcaggagcugaggggaguuguagggaacugaggggagcugcugugucccccgccuccuccuccccauuuccgcgcucccgggaccauguccgcgcuggcgggugaagaugucuggagguguccaggcuguggggaccacauugcuccaagccagauaugguacaggacugucaacgaaaccuggcacggcucuugcuuccgguguucagaaugccaggauucccucaccaacugguacuaugagaaggaugggaagcucuacugccccaaggacuacugggggaaguuuggggaguucugucaugggugcucccugcugaugacagggccuuuuaugguggcuggggaguucaaguaccacccagagugcuuugccuguaugagcugcaaggugaucauugaggauggggaugcauaugcacuggugcagcaugccacccucuacugugggaagugccacaaugagguggugcuggcacccauguuugagagacucuccacagagucuguucaggagcagcugcccuacucugucacgcucaucuccaugccggccaccacugaaggcaggcggggcuucuccguguccguggagagugccugcuccaacuacgccaccacugugcaagugaaagaggucaaccggaugcacaucagucccaacaaucgaaacgccauccacccuggggaccgcauccuggagaucaaugggacccccguccgcacacuucgaguggaggagguggaggaugcaauuagccagacgagccagacacuucagcuguugauugaacaugaccccgucucccaacgccuggaccagcugcggcuggaggcccggcucgcuccucacaugcagaaugccggacacccccacgcccucagcacccuggacaccaaggagaaucuggaggggacacugaggagacguucccuaaggcgcaguaacaguaucuccaaguccccuggccccagcuccccaaaggagccccugcuguucagccgugacaucagccgcucagaaucccuucguuguuccagcagcuauucacagcagaucuuccggcccugugaccuaauccauggggagguccuggggaagggcuucuuugggcaggcuaucaaggugacacacaaagccacgggcaaagugauggucaugaaagaguuaauucgaugugaugaggagacccagaaaacuuuucugacugaggugaaagugaugcgcagccuggaccaccccaaugugcucaaguucauuggugugcuguacaaggauaagaagcugaaccuccugacagaguacauugaggggggcacacugaaggacuuucugcgcaguauggauccguuccccuggcagcagaaggucagguuugccaaaggaaucgccuccggaauggccuauuugcacucuaugugcaucauccaccgggaucugaacucgcacaacugccucaucaaguuggacaagacuguggugguggcagacuuugggcugucacggcucauaguggaagagaggaaaagggcccccauggagaaggccaccaccaagaaacgcaccuugcgcaagaacgaccgcaagaagcgcuacacgguggugggaaaccccuacuggauggccccugagaugcugaacggaaagagcuaugaugagacgguggauaucuucuccuuugggaucguucucugugagaucauugggcagguguaugcagauccugacugccuuccccgaacacuggacuuuggccucaacgugaagcuuuucugggagaaguuuguucccacagauugucccccggccuucuucccgcuggccgccaucugcugcagacuggagccugagagcagaccagcauucucgaaauuggaggacuccuuugaggcccucucccuguaccugggggagcugggcaucccgcugccugcagagcuggaggaguuggaccacacugugagcaugcaguacggccugacccgggacucaccucccuagcccuggcccagcccccugcagggggguguucuacagccagcauugccccucugugccccauuccugcugugagcagggccguccgggcuuccuguggauuggcggaauguuuagaagcagaacaagccauuccuauuaccuccccaggaggcaagugggcgcagcaccagggaaauguaucuccacagguucuggggccuaguuacugucuguaaauccaauacuugccugaaagcugugaagaagaaaaaaaccccuggccuuugggccaggaggaaucuguuacucgaauccacccaggaacucccuggcaguggauugugggaggcucuugcuuacacuaaucagcgugaccuggaccugcugggcaggaucccagggugaaccugccugugaacucugaagucacuaguccagcugggugcaggaggacuucaaguguguggacgaaagaaagacugauggcucaaagggugugaaaaagucagugaugcucccccuuucuacuccagauccuguccuuccuggagcaagguugagggaguagguuuugaagagucccuuaauaugugguggaacaggccaggaguuagagaaagggcuggcuucuguuuaccugcucacuggcucuagccagcccagggaccacaucaaugugagaggaagccuccaccucauguuuucaaacuuaauacuggagacuggcugagaacuuacggacaacauccuuucugucugaaacaaacagucacaagcaaaggaagaggcugggggacuagaaagaggcccugcccucuagaaagcucagaucuuggcuucuguuacucauacucgggugggcuccuuagucagaugccuaaaacauuuugccuaaagcucgauggguucuggaggacaguguggcuugucacaggccuagagucugagggaggggagugggagucucagcaaucucuuggucuuggcuucauggcaaccacugcucacccuucaacaugccugguuuaggcagcagcuugggcugggaagaggugguggcagagucucaaagcugagaugcugagagagauagcucccugagcugggccaucugacuucuaccucccauguuugcucucccaacucauuagcuccugggcagcauccuccugagccacaugugcagguacuggaaaaccuccaucuuggcucccagagcucuaggaacucuucaucacaacuagauuugccucuucuaagugucuaugagcuugcaccauauuuaauaaauugggaauggguuugggguauuaaugcaauguguggugguuguauuggagcagggggaauugauaaaggagagugguugcuguuaauauuaucuuaucuauugggugguaugugaaauauuguacauagaccugaugaguugugggaccagaugucaucucuggucagaguuuacuugcuauauagacuguacuuaugugugaaguuugcaagcuugcuuuagggcugagcccuggacucccagcagcagcacaguucagcauuguguggcugguuguuuccuggcuguccccagcaaguguaggaguggugggccugaacugggccauugaucagacuaaauaaauuaagcaguuaacauaacuggcaa

SEQ ID NO: 205 - RNA, 3848 nt, Homo_Sapiens
ugacagcagcgcuucuuucuuagcuagucaccggccccugcucaagaaugccaguguguguguagccuccacagagaggucguuuucucggaguccagaggggccgccugagcuucugagaacuagggaggagccaucccagccaugagccccugugggaaucugcugggggccaaguggccuggaguccucaggcucccgcagcugcuccggagggagaggugagcucagggcagccugccugcagccagaggugccgggagccccgggccugucaugguggccaucuacagccggccugaggcagucacagacggauuugcagcugagccugucuaucuggugugggaagaagauggggaguuacuugucagucccggcuuacuucaccuccagagaccuguuucgguguucagaaugccaggauucccucaccaacugguacuaugagaaggaugggaagcucuacugccccaaggacuacugggggaaguuuggggaguucugucaugggugcucccugcugaugacagggccuuuuaugguggcuggggaguucaaguaccacccagagugcuuugccuguaugagcugcaaggugaucauugaggauggggaugcauaugcacuggugcagcaugccacccucuacugugggaagugccacaaugagguggugcuggcacccauguuugagagacucuccacagagucuguucaggagcagcugcccuacucugucacgcucaucuccaugccggccaccacugaaggcaggcggggcuucuccguguccguggagagugccugcuccaacuacgccaccacugugcaagugaaagaggucaaccggaugcacaucagucccaacaaucgaaacgccauccacccuggggaccgcauccuggagaucaaugggacccccguccgcacacuucgaguggaggagguggaggaugcaauuagccagacgagccagacacuucagcuguugauugaacaugaccccgucucccaacgccuggaccagcugcggcuggaggcccggcucgcuccucacaugcagaaugccggacacccccacgcccucagcacccuggacaccaaggagaaucuggaggggacacugaggagacguucccuaaggcgcaguaacaguaucuccaaguccccuggccccagcuccccaaaggagccccugcuguucagccgugacaucagccgcucagaaucccuucguuguuccagcagcuauucacagcagaucuuccggcccugugaccuaauccauggggagguccuggggaagggcuucuuugggcaggcuaucaaggugacacacaaagccacgggcaaagugauggucaugaaagaguuaauucgaugugaugaggagacccagaaaacuuuucugacugaggugaaagugaugcgcagccuggaccaccccaaugugcucaaguucauuggugugcuguacaaggauaagaagcugaaccuccugacagaguacauugaggggggcacacugaaggacuuucugcgcaguauggauccguuccccuggcagcagaaggucagguuugccaaaggaaucgccuccggaauggccuauuugcacucuaugugcaucauccaccgggaucugaacucgcacaacugccucaucaaguuggacaagacuguggugguggcagacuuugggcugucacggcucauaguggaagagaggaaaagggcccccauggagaaggccaccaccaagaaacgcaccuugcgcaagaacgaccgcaagaagcgcuacacgguggugggaaaccccuacuggauggccccugagaugcugaacggaaagagcuaugaugagacgguggauaucuucuccuuugggaucguucucugugagaucauugggcagguguaugcagauccugacugccuuccccgaacacuggacuuuggccucaacgugaagcuuuucugggagaaguuuguucccacagauugucccccggccuucuucccgcuggccgccaucugcugcagacuggagccugagagcagaccagcauucucgaaauuggaggacuccuuugaggcccucucccuguaccugggggagcugggcaucccgcugccugcagagcuggaggaguuggaccacacugugagcaugcaguacggccugacccgggacucaccucccuagcccuggcccagcccccugcagggggguguucuacagccagcauugccccucugugccccauuccugcugugagcagggccguccgggcuuccuguggauuggcggaauguuuagaagcagaacaagccauuccuauuaccuccccaggaggcaagugggcgcagcaccagggaaauguaucuccacagguucuggggccuaguuacugucuguaaauccaauacuugccugaaagcugugaagaagaaaaaaaccccuggccuuugggccaggaggaaucuguuacucgaauccacccaggaacucccuggcaguggauugugggaggcucuugcuuacacuaaucagcgugaccuggaccugcugggcaggaucccagggugaaccugccugugaacucugaagucacuaguccagcugggugcaggaggacuucaaguguguggacgaaagaaagacugauggcucaaagggugugaaaaagucagugaugcucccccuuucuacuccagauccuguccuuccuggagcaagguugagggaguagguuuugaagagucccuuaauaugugguggaacaggccaggaguuagagaaagggcuggcuucuguuuaccugcucacuggcucuagccagcccagggaccacaucaaugugagaggaagccuccaccucauguuuucaaacuuaauacuggagacuggcugagaacuuacggacaacauccuuucugucugaaacaaacagucacaagcaaaggaagaggcugggggacuagaaagaggcccugcccucuagaaagcucagaucuuggcuucuguuacucauacucgggugggcuccuuagucagaugccuaaaacauuuugccuaaagcucgauggguucuggaggacaguguggcuugucacaggccuagagucugagggaggggagugggagucucagcaaucucuuggucuuggcuucauggcaaccacugcucacccuucaacaugccugguuuaggcagcagcuugggcugggaagaggugguggcagagucucaaagcugagaugcugagagagauagcucccugagcugggccaucugacuucuaccucccauguuugcucucccaacucauuagcuccugggcagcauccuccugagccacaugugcagguacuggaaaaccuccaucuuggcucccagagcucuaggaacucuucaucacaacuagauuugccucuucuaagugucuaugagcuugcaccauauuuaauaaauugggaauggguuugggguauuaaugcaauguguggugguuguauuggagcagggggaauugauaaaggagagugguugcuguuaauauuaucuuaucuauugggugguaugugaaauauuguacauagaccugaugaguugugggaccagaugucaucucuggucagaguuuacuugcuauauagacuguacuuaugugugaaguuugcaagcuugcuuuagggcugagcccuggacucccagcagcagcacaguucagcauuguguggcugguuguuuccuggcuguccccagcaaguguaggaguggugggccugaacugggccauugaucagacuaaauaaauuaagcaguuaacauaacuggcaa

SEQ ID NO: 206 - RNA, 1260 nt, Homo_Sapiens
ggccggcgggaagacuccguuacccagcgagcgaggcggcggcgcagggccagcggacuccauuucccgucggcucgcggugggagcgccggaagcccgccccaccccucauugugcggcuccuacuaaacggaaggggccgggagaggccgcguucagucgggucccggcagcggcugcagcgcucucgucuucugcggcucucggugcccucuccuuuucguuuccggaaacauggccuccgguguggcugucucugauggugucaucaagguguucaacgacaugaaggugcguaagucuucaacgccagaggaggugaagaagcgcaagaaggcggugcucuucugccugagugaggacaagaagaacaucauccuggaggagggcaaggagauccuggugggcgaugugggccagacugucgacgaccccuacgccaccuuugucaagaugcugccagauaaggacugccgcuaugcccucuaugaugcaaccuaugagaccaaggagagcaagaaggaggaucugguguuuaucuucugggcccccgagucugcgccccuuaagagcaaaaugauuuaugccagcuccaaggacgccaucaagaagaagcugacagggaucaagcaugaauugcaagcaaacugcuacgaggaggucaaggaccgcugcacccuggcagagaagcuggggggcagugccgucaucucccuggagggcaagccuuugugagccccuucuggcccccugccuggagcaucuggcagccccacaccugcccuuggggguugcaggcugcccccuuccugccagaccggaggggcuggggggaucccagcagggggagggcaaucccuucaccccaguugccaaacagaccccccacccccuggauuuuccuucucccuccaucccuugacgguucuggccuucccaaacugcuuuugaucuuuugauuccucuugggcugaagcagaccaaguuccccccaggcaccccaguugugggggagccuguauuuuuuuuaacaacauccccauuccccaccugguccucccccuucccaugcugccaacuucuaaccgcaauagugacucugugcuugucuguuuaguucuguguauaaauggaauguuguggagaugaccccucccugugccggcugguuccucucccuuuuccccuggucacggcuacucauggaagcaggaccaguaagggaccuucgauuaaaaaaaaaaaagacaauaauaaaaa

SEQ ID NO: 207 - RNA, 3713 nt, Homo_Sapiens
gggaaggguguuuggagggcagcggccgccccaagccggagccccgcagcgcuucuuaugaucagcucggugugugucuccuccuaccgcgggcgcaagucggggaacaagccuccguccaaaacaugucugaaggaggagauggccaagggcgaggcgucggagaagaucaucaucaacgugggcggcacgcgacaugagaccuaccgcagcacccugcgcacccuaccgggaacccgccucgccuggcuggccgaccccgacggcgggggccggcccgagaccgauggcggcgguguggguagcagcggcagcagcggcggcgggggcugcgaguucuucuucgacaggcacccgggcgucuucgccuacgugcucaacuacuaccgcaccggcaagcugcacugccccgcggacgugugcgggccgcucuucgaagaggagcucaccuucuggggcaucgacgagaccgacguggaacccugcugcuggaugaccuaccggcagcaccgcgacgccgaggaggcgcucgacaucuucgagagcccggacggaggcggcagcggcgcggggcccagcgacgaggccggcgacgaugagcgggagcuggcccugcagcgacugggcccccacgagggaggcgcgggccauggcgccgggucugggggcugccgcggcuggcagccccgcaugugggcgcucuucgaggaucccuacuccucccgggccgcuaggguaguggccuuugccucucucuucuucauccuggucuccaucaccacuuucugccuggagacccaugaggccuuuaauaucgaccgcaacgugacagagauccuccgcguagggaacaucaccagcgugcacuuccggcgggagguagagacagagcccauccugaccuacaucgagggcguaugugugcugugguucacacuggaguuccuggugcgcaucgugugcugccccgacacgcuggacuucgucaagaaccugcucaacaucaucgacuuuguggccauccugcccuucuaccuggagguggggcugagcggccugucauccaaggcggcccgcgacgugcugggcuuccugcgcguggugcgcuucgugcgcauccugcguaucuucaagcucacacgccacuucguggggcuacgcgugcugggccacacccugagggccagcaccaaugaguuccugcugcuuaucaucuuccuggcccugggugugcucaucuuugccaccaugaucuacuacgcugagcgcauuggggccaggcccuccgacccucgggguaaugaccacaccgacuucaagaacauccccauuggcuucuggugggcuguggucaccaugacgacacugggcuacggagacauguaccccaagacguggucaggcaugcugguaggggcacugugugcacuggcuggcgugcucaccaucgccaugccggugccugucaucgucaacaacuucggcauguacuacucccuggccauggccaagcagaagcugcccaagaaacggaagaagcacgugccacggccggcgcagcuggagucacccauguacugcaagucugaggagacuuccccccgggacagcaccugcagugauaccagccccccugcccgggaagaggguaugaucgagaggaaacgggcagacucuaagcagaauggcgaugccaacgcagugcugucugaugaggagggagcuggccucacccaaccccuggccuccuccccgacccccgaggagcgccgggcccugcgacgcuccaccacucgagacagaaacaagaaggcagcugccugcuuccugcucagcacuggggacuaugccugcgccgaugguaguguccggaaaggcacauucguccuccgugaccuuccccuucagcauucaccugaggcugcaugcccuccaacugcugggacucuguuccugccacauugaggaagggggcugggcacgacauggcaucauacucaggagccuucuucaccagcuccuugggacaauggaauaucccaggguggugacagcagauggagcuacuugggggagagcucaaguuggucaggcaacagcuggggugauggccugugagccacaggccacaucaggaacuuuccccacugccuccaugcaaggcugcagagcuauggucccuuucuccacugcacuggagcuuugaagaccuaagaggcuagugguuccuggagcuagugguuaccugaacagguauggcgaugagcuacaacaucaccugagucaccagaguuggguuggcagaggggugaaggguucaccccauucccugacccauccaugcucuuccuggccuuuuagcccuggguuccucaugccuuccagcucugcuccuggucuacuccuuagcccacacccugugggucagcagcuggcuuccuucuaacgucucauucuuuguuucucccuuucuuuugcugaacucccuguccccccaaccccagaaggcaauguugagccgaaagcgugcgucccagugucucacaccugugcucuuuaaacacagagaccugccaagacgcccucucguccaacuaugcccaggcugaaguccucacccucucuuaaagcggcaccaacgugagagagacaggcagacagacagaaagccagaggcuuagggaaacucuggaacccagacaagaaucuuuucgcugggaaagacucagauauccuuguuugcacaggacugguggaaaaucucccaugcgacccucggggcccagagccaucugggucugauguucuguuccauuguacaucgaagagauauauaugcacauauaguaucuauauucauacauauuauacucuuguguguagugcacgugcuauuggugguuugucuucuuuguuaggcugugucucccuaagcccuugccccacccagaguuucccguccccuucacugauuucuguuguuucugcugacuguguggguggaaugucccaagaaaagugcaucugggaauugccaguccagcuggguagucccaggcuccugucuuggggauguuuccccugucagcaaguaaccuggugaagucuauugaaggccagacugcccccuagggucacugcuucacuagccgcaccccaccccagauugggguucuaccucccaccccacauccucguuguggggggacuuccaggggcuccucugcagccuccuccacuacuuccuccaccccaucuauguccuugacuuaggggggcauuuugucuuuuuuagauuugauuuuguucucucuccuuugucuguuuguugucaaagaugcugcugggcagacaggcagggaaaggaucugucugcccaucuggcccaggggguccgagaagggaagccuugggcaagaggagaccaguugcaauacuguacuuccuggucaguggccagaggaugcgugcaauagcagaggccaggugaccccuucagccuuggccucugccccucccuuggcccucccucccugcuccucccugguguuggucaguccuuuucuaaagcuguccccucgugugugucuggggcaugcccaggcugggcccugugcccugucugcaugccuccaacugucaugcugugcucgagccccaauaaagacaucuggagcauccugcugcuccugcugugugaaaaaaaaaaaaaa

SEQ ID NO: 208 - RNA, 1855 nt, Homo_Sapiens
gggaaggguguuuggagggcagcggccgccccaagccggagccccgcagcgcuucuuaugaucagcucggugugugucuccuccuaccgcgggcgcaagucggggaacaagccuccguccaaaacaugucugaaggaggagauggccaagggcgaggcgucggagaagaucaucaucaacgugggcggcacgcgacaugagaccuaccgcagcacccugcgcacccuaccgggaacccgccucgccuggcuggccgaccccgacggcgggggccggcccgagaccgauggcggcgguguggguagcagcggcagcagcggcggcgggggcugcgaguucuucuucgacaggcacccgggcgucuucgccuacgugcucaacuacuaccgcaccggcaagcugcacugccccgcggacgugugcgggccgcucuucgaagaggagcucaccuucuggggcaucgacgagaccgacguggaacccugcugcuggaugaccuaccggcagcaccgcgacgccgaggaggcgcucgacaucuucgagagcccggacggaggcggcagcggcgcggggcccagcgacgaggccggcgacgaugagcgggagcuggcccugcagcgacugggcccccacgagggaggcgcgggccauggcgccgggucugggggcugccgcggcuggcagccccgcaugugggcgcucuucgaggaucccuacuccucccgggccgcuaggguaguggccuuugccucucucuucuucauccuggucuccaucaccacuuucugccuggagacccaugaggccuuuaauaucgaccgcaacgugacagagauccuccgcguagggaacaucaccagcgugcacuuccggcgggagguagagacagagcccauccugaccuacaucgagggcguaugugugcugugguucacacuggaguuccuggugcgcaucgugugcugccccgacacgcuggacuucgucaagaaccugcucaacaucaucgacuuuguggccauccugcccuucuaccuggagguggggcugagcggccugucauccaaggcggcccgcgacgugcugggcuuccugcgcguggugcgcuucgugcgcauccugcguaucuucaagcucacacgccacuucguggggcuacgcgugcugggccacacccugagggccagcaccaaugaguuccugcugcuuaucaucuuccuggcccugggugugcucaucuuugccaccaugaucuacuacgcugagcgcauuggggccaggcccuccgacccucgggguaaugaccacaccgacuucaagaacauccccauuggcuucuggugggcuguggucaccaugacgacacugggcuacggagacauguaccccaagacguggucaggcaugcugguaggggcacugugugcacuggcuggcgugcucaccaucgccaugccggugccugucaucgucaacaacuucggcauguacuacucccuggccauggccaagcagaagcugcccaagaaacggaagaagcacgugccacggccggcgcagcuggagucacccauguacugcaagucugaggagacuuccccccgggacagcaccugcagugauaccagccccccugcccgggaagaggguaugaucgagaggaaacgggcaggugagauuagggguugggaaggaaaaucccuuuucccccaguggccuagggaguuuccaaauggaccucagaccuugggauuuggcauguguuuuguguggggcuucccuaagcauaaagaugugccuuuaugagggcaaaguguugaggccgaauuucucuguccucuggcugggucuccga

SEQ ID NO: 209 - RNA, 3023 nt, Homo_Sapiens
gggaaggguguuuggagggcagcggccgccccaagccggagccccgcagcgcuucuuaugaucagcucggugugugucuccuccuaccgcgggcgcaagucggggaacaagccuccguccaaaacaugucugaaggaggagauggccaagggcgaggcgucggagaagaucaucaucaacgugggcggcacgcgacaugagaccuaccgcagcacccugcgcacccuaccgggaacccgccucgccuggcuggccgaccccgacggcgggggccggcccgagaccgauggcggcgguguggguagcagcggcagcagcggcggcgggggcugcgaguucuucuucgacaggcacccgggcgucuucgccuacgugcucaacuacuaccgcaccggcaagcugcacugccccgcggacgugugcgggccgcucuucgaagaggagcucaccuucuggggcaucgacgagaccgacguggaacccugcugcuggaugaccuaccggcagcaccgcgacgccgaggaggcgcucgacaucuucgagagcccggacggaggcggcagcggcgcggggcccagcgacgaggccggcgacgaugagcgggagcuggcccugcagcgacugggcccccacgagggaggcgcgggccauggcgccgggucugggggcugccgcggcuggcagccccgcaugugggcgcucuucgaggaucccuacuccucccgggccgcuaggguaguggccuuugccucucucuucuucauccuggucuccaucaccacuuucugccuggagacccaugaggccuuuaauaucgaccgcaacgugacagagauccuccgcguagggaacaucaccagcgugcacuuccggcgggagguagagacagagcccauccugaccuacaucgagggcguaugugugcugugguucacacuggaguuccuggugcgcaucgugugcugccccgacacgcuggacuucgucaagaaccugcucaacaucaucgacuuuguggccauccugcccuucuaccuggagguggggcugagcggccugucauccaaggcggcccgcgacgugcugggcuuccugcgcguggugcgcuucgugcgcauccugcguaucuucaagcucacacgccacuucguggggcuacgcgugcugggccacacccugagggccagcaccaaugaguuccugcugcuuaucaucuuccuggcccugggugugcucaucuuugccaccaugaucuacuacgcugagcgcauuggggccaggcccuccgacccucgggguaaugaccacaccgacuucaagaacauccccauuggcuucuggugggcuguggucaccaugacgacacugggcuacggagacauguaccccaagacguggucaggcaugcugguaggggcacugugugcacuggcuggcgugcucaccaucgccaugccggugccugucaucgucaacaacuucggcauguacuacucccuggccauggccaagcagaagcugcccaagaaacggaagaagcacgugccacggccggcgcagcuggagucacccauguacugcaagucugaggagacuuccccccgggacagcaccugcagugauaccagccccccugcccgggaagaggguaugaucgagaggaaacgggcagacucuaagcagaauggcgaugccaacgcagugcugucugaugaggagggagcuggccucacccaaccccuggccuccuccccgacccccgaggagcgccgggcccugcgacgcuccaccacucgagacagaaacaagaaggcagcugccugcuuccugcucagcacuggggacuaugccugcgccgaugguaguguccggaaagagaccugccaagacgcccucucguccaacuaugcccaggcugaaguccucacccucucuuaaagcggcaccaacgugagagagacaggcagacagacagaaagccagaggcuuagggaaacucuggaacccagacaagaaucuuuucgcugggaaagacucagauauccuuguuugcacaggacugguggaaaaucucccaugcgacccucggggcccagagccaucugggucugauguucuguuccauuguacaucgaagagauauauaugcacauauaguaucuauauucauacauauuauacucuuguguguagugcacgugcuauuggugguuugucuucuuuguuaggcugugucucccuaagcccuugccccacccagaguuucccguccccuucacugauuucuguuguuucugcugacuguguggguggaaugucccaagaaaagugcaucugggaauugccaguccagcuggguagucccaggcuccugucuuggggauguuuccccugucagcaaguaaccuggugaagucuauugaaggccagacugcccccuagggucacugcuucacuagccgcaccccaccccagauugggguucuaccucccaccccacauccucguuguggggggacuuccaggggcuccucugcagccuccuccacuacuuccuccaccccaucuauguccuugacuuaggggggcauuuugucuuuuuuagauuugauuuuguucucucuccuuugucuguuuguugucaaagaugcugcugggcagacaggcagggaaaggaucugucugcccaucuggcccaggggguccgagaagggaagccuugggcaagaggagaccaguugcaauacuguacuuccuggucaguggccagaggaugcgugcaauagcagaggccaggugaccccuucagccuuggccucugccccucccuuggcccucccucccugcuccucccugguguuggucaguccuuuucuaaagcuguccccucgugugugucuggggcaugcccaggcugggcccugugcccugucugcaugccuccaacugucaugcugugcucgagccccaauaaagacaucuggagcauccugcugcuccugcugugugaaaaaaaaaaaaaa

SEQ ID NO: 210 - RNA, 3070 nt, Homo_Sapiens
gagcccagagccagagagcgcgcugggcggugcugggcacccgcggaguggaacggggcugguggaaugcacagggucgcagcgcuugggccacccucggucagagggcgccguguccagcgagcaaacgggcgccccggagccuugcugagaggcagcucugggcuuucccagcuccgaagucaauacugagaucccagauguguccagagacauccugaagaggcucggggguggaggagccuuaguguguccacaaagggacuccugaaacugacugagagccaguggauuugccagcagucugagcuucuaccgagucuucccccaccucaaucccuguugcuauggagacuaccaauggaacggagaccugguaugagagccugcaugccgugcugaaggcucuaaaugccacucuucacagcaauuugcucugccggccagggccagggcuggggccagacaaccagacugaagagaggcgggccagccuaccuggccgugaugacaacuccuacauguacauucucuuugucauguuucuauuugcuguaacugugggcagccucauccugggauacacccgcucccgcaaaguggacaagcguagugaccccuaucauguguauaucaagaaccgugugucuaugaucuaacacgagagggcugggacgguggaagaccaagacaccuggggauugcgucuggggccuccagaacucugcuguggacugcaucaggucucagugucccuaucuguaagaucaacaagaaacacgguuaagggaggucgucacuggggugggagaagaggggcugguagaccgaagccuugugcauaaggauuuuuucccaggaaaagauagacuuuauaaacagugggagcccaugaacaaacauauaaaaguagcaacagauaaugaccaauaacugguucaguggcuggaguauuaggggccuggggauuggagaacggagaagaaguuguagcagagggaaaugagacaggaagaugcucuggggacacauuuuuuauguguuaucuucagccaugagaagcagugaugacuaucccauaucacagauaugauuuaccaccaccacccugcccccgcucccgugaagaaagcagggcaagugcugugcugcccauuugggccugcauagugccaugauuggaacccaggaacucuggucuccuugccuagugcuuuucaaaacucugugcuacacaggaguggauccaggccugaaggucauacaauucuggggacucucuuuaagaaaaagaauucuaaaauaucuuacuuuugcaaacauuaugaaaauauacugccacauuaauauguugcuagggccccugcuaggaccuuaagaaggagcucaugugagucaggacccugaauguuaggccucguuagcucuaugguucauaugcuucuugaaccaagucacagggcacuucccagccacauugccaggcaacaggacuaaacuaccuccaaagcaagcagucuuuucaguuuugacugagugaugugagaaacuucuuuucuuuucuuuucuuuuuuuuuuuuugagacagucucccuaugucacccaggcuguggugcagcaacccaaucuuggcucacugcaacccccaccucccggguucaagcaauuauccugccucagccaccugaguagcugggauuacagguuccugucaccacacccaguuaauuuauauauauauauauauauauauauuuaaguagagacaggguuucacauguugcccaggcuggucucgaacuccuguccucaaguuaucugcccauuuuggucucccaaagugcugggauuacaaguguaagccaccacgacuaucugagagaaguuuucugaugucauguugaaucugcuucuaaaagacugauacugccaaggugggcggaucaccugaggucaggaguucgagaccagccuggccaacauggugaaaccccaucuacuaaaaaaauacaaaaauuagccagaccugguggcgggugcccguauucccagcuacuugggaggcugaggcaggagaauuguuugaacccgggagguggagguugcaguaagccaagaucacgccacugcacuccagccugggugacagagcaaggcucugucucaaaaaaaaacaaaaacaaaaacaaaaaagacugauaucgcaccuaaauuauuauuauauuaaaagaagcagaguaugagagacagguacaugguccaguaggaagagaagcagcccugauucuaccacuuaaggugauguaugaucuuaggcuggacacuucucucccucauccguuuuccucuucaacauaaugaaauagacuugaaagucucuaaggcucuaucaguucugacauucuaggcuucauauacauuaaguugagccauauguaaucacuguguuuguagguuagaaacagcugaguaucguaguuucauauaugguuccagcuaauacaugcaauguggcuggugaacacuucugaauucagaaacuaucccagaucucagcuagaaccauccacuguucuguuuguccaguuucaacuuaagggaucuccaugcggucccuggaaguacccauugaaacaugcguauuuguguauagcagaacucugaaauaauauucugacagcaguuaucucugaggaauuggguuauaggugauuuucccuuuccgcaugauaaauuuauguaauauuugacugacuugaccguaaguauguuacuuguauaauaaaaggaaaaaagguacuucuauuuugaaaaaauaaaaauaaaagccuuuggguucuugaauggaggaucauggaacacauuugcugccauaugcaguuauguugaugcucugcaaaccugugcugagcccuguugcucaagcccuuccucaucucuucuugagggagaagguggagacuuccuuaaggagaugugacauaugggaagacaacagauucagaaauuuacguggauaggacuuuagacaccacccagcccaaacuuccaaauaaaauauggaacgcaa

SEQ ID NO: 211 - RNA, 5894 nt, Homo_Sapiens
augcauugugggccucccgacauggucugcgagacgaagaucguggccgccgaggaccaugaggcgcugccgggggccaagaaggacgcgcugcucgccgccgccggcgccauguggcccccgcugcccgccgcgcccgggccggccgccgcgccccccgcgcccccaccugccccgguggcucagccucacggcggggcggggggcgcggggccgccgggggggcgcggcgugugcauccgcgaguuccgugcggccgagcaggaggcggcgcgccgcaucuucuacgacggcaucauggagcgcaucccuaacacggccuuccgcggccugcggcagcacccgcgcgcgcagcugcucuacgcccugcuggcggcgcugugcuucgccgugagccgcucgcugcugcugacgugccuggugccggccgcgcugcugggccugcgcuacuacuacagccgcaaggugauccgcgccuaccuggagugcgcgcugcacacggacauggcggacaucgagcaguacuacaugaagccgcccggcuccugcuucuggguggccgugcuggauggcaacguggugggcauuguggcugcacgggcccacgaggaggacaacacgguggagcugcugcggaugucuguggacucacguuuccgaggcaagggcaucgccaaggcgcugggccggaaggugcuggaguucgccguggugcacaacuacuccgcgguggugcugggcacgacggccgucaagguggccgcccacaagcucuacgagucgcugggcuucagacacaugggcgccagugaccacuacgugcugccgggcaugacccucucgcuggcugagcgccucuucuuccagguccgcuaccaccgcuaccgccugcagcugcgcgaggagugaccgccgccgcucgcccgcccgcccccccggccgcccuguccgccuuugcccgccugcccgccgcccggcgcggccugcuuucagacgcucaauuggcguuuguguuggguuuccccuuuucaacauccugcgguugucuggcugguuccggggggugcggggcuguuguucuucggcgacacuuugguggggguggguuguuugucgccauagccccucgcccuuccccaccugccugggcggcuugccaccugaagaguggcaucuuggaccaccgcggcuguccaugacgcugcccugcccgccgccacuggggaaggcccagccuugcucaccaagcacagaaccucugcagcagaucccggggccaggcuccggccccgccugcggccccagcgccacugccuguggaggccccagcuggccacggcgcugcuuugcuccgcgcaugccgaggguguggcccggcugagcaugccgcaugcacacagccccgcccugccgcccugcccagacuggacccggagacccgggcuggugagcgccccuguccccagcccccagcuggcugugggagggccugccccugcccccaccuccuggagggccuggucugccccgcgccgcccggcucuguccacaccugcuuugcucugacgcccuccauuucucuggcuccggccccuccccugccugggcugugcugacuggugucaucacccaggugacucccauggcguccguggcacagccaggguggggguccaugggaccccucuccccagugcccacuggaucgugcuggccucucccagauguccccggggaccuccugccucuggcugacgguccacccugugaaucuuaucagcccaggcugcugccaacagcgcccagcccacagcuucucccagccugaaaccaacacauuuucuaauaaguuauuuagacagaauagcacucugcaugacuuuaauucuugggacaaaacgguaguuuguacccuaagacacaguuucuggcccagugugauggggguggguggccggguggguggagcguuuugcuguuggaaaccuggagggaaacccugauuggaugucauuuccugccauggagcacgccucccagcccuggccugcagugugggcaggguggggggcaagggaguccgcagccuccgggaggaggggcagggcgcugccuugggcugggugggaagagggguggccgccucggcuuccgcuggccaugcuccuggucucuccuuccugaggucacaggcaggggcugcccuggacggggggcgggggggguggccuggaaggggagacagagguggaggguggcacaggcugcacauucagcuuagaaguggaccuggcuuugguggcaggagaagaauaaacacuugcccagaccccuuugugugggggaauuggggaggggucguggcaggcagggugggccacggaacugggucccaggcaucaaggccacgugcagggccauggagggaugcuucucacgaggcgcuucagaagcgagcgaagggacagagaagcccugcguccaagggccuuuuguccuguuagcaauugaggugugcagagcacuguacagaccccacuccccuguacauuccucccuggaggugcccgguccccgcuuggggaugggaguuuuguagacuguacagaaaucggcacccuauuuucuugcagcucagauuuuguuaaucuggaauauacagacagacguaaaguguuuuagcaaaauggaaacaaacaguugugccuuuuuccucuuuugguuugguuuggguuuggccuggggcuggucccaguuggugcggggcaugcugggggcaggaggggcagggcgggccagguggagucaggucuugggggugucaugucggggugcugccagcgucccuugguccugugccuuuggagccucgggcuccuggggugcagggugcuuggggguggcuguuggagcccaccgacgccagggcagggccuggaggcccagggacugccagugucuccuugauauugauccuagcagaucccccuccuggggguucugagaguccugggcaguguggccuucucucauucugguggcaucugcgcccgugagugaccucuuccuuggcugcacugcccuguggguggugagacgcuuggccuuuuuuguugcugccaggacuugguagagauggcaggaagggugugcggggugguugugugcagaacccugccgccccugaggugagcagaggcacuggugugccugccaggcuggggcggagcugcccggaacccuugccaggccaauguguagcuugguggcgcccuugaaggccacugggggguagguguguccucccccggggcuggaggccgggugccuggugggugggccugaccuggcccaccucaucccuccagccugggaucucacugcucugcacaugugcacugacgugaauuuuauacguuuguagaaacucugauguaacuucuucuaccucugaagcgcccuccugggcccugcugucacguggcuggugcggcuuccccgagugcuggcccccugcccgcuccccaugggcacccaccacucaaacucugcguggugaggcccggggaaagccaggccgggcccuagcacugcucaggggccuggggcuccugggauuucuguguguuuggaagccucuguuuuuggaguggggggcguggaaggcgggaggggcugacagugccuggggccagagcugggcgaaggaggacauccucacuggacgagcacugcaggccugacgagaggcuccgggcagcugagggcugaagcgccucgggaugccccacacugcccagagccacgggucuugcugugcugggggugggguggccccaggcagcugccacugcccaggugugagucgcugcagaccuggucccugagggugggaggccugcuugugcugaagcugccauguggucuggcccccagaagggcuccugagcguagggaguugagccccgcagccguggcggcaucuccuccuccuuccuccgccccaugcccagccuugcuuccggcugguggcaugccuuggggccgggcagcaggugagaagcugcccccggagggaggggccaagggcugggucagucuggccugagggguggauggcuggcccugggggaaggcugggccugggaggcccuguggacagcaggccugaggccacgagguccuggggccaccccucuccugcucuggguguccuucucagagaagauggcagaaggcugcaggcccuagaggggacgacgggcuggggacgcccugagcuuccuggcuguguggcaggugcuggggaagcucucugggccauagggaccuggcuccccucugagaggcccgccugcccuggggcacccagggcugugcugguggccugaggcugggaacuuggguuccugggcucugcuggcgccugggcuuugugggggccgaaggugguugccccgccgggcagggggcugugugggcccucguggggccaccuuccugucagugcccgagggacggugggacaguugccccugcgccaagggagcccacugccaucccccgugggcuggcgcugcagucgcgcacccuguguugccugcugacuugcuuaugucuguuuggaagcugcuucuguuuggccacaggccuguguuccugggcugauggccacagagcugacacuugggguuugaguuccagacuugcagacccugggauccgcuuacuccuccgcgccacggcugcugugcuuccagagguggcgugaugccucccggggccaugguggggugaaggauggcgagccggacauaccauuguuggauguauuuuuuuuaaaacagcaauaauuagccauuuuaaaggagggauguaccugugugugugcaugugcacguguuugagcgugugugugugugcaaguggguucuuggauauguguagugugagcaugugugcaugugugagccugugcacgugcauguuguaggugcauaagcauguacacgcgugagcaugcauguguguguacacguguauagguguacaugugcaugaguuguguacaugcgugagcacguguauagauguacgugugugugcgcaugugugcguguacauguguuugugucuuggguaugcauaagcaugcacguguguaugaaugugcguguguaugcaugagcacguaugcaugugugaugcgcauguucuuguguacuucucugagggggcacauauguaugaguguaugagugcauacauaugcauaugguguacguguguguacuuugugugugggcauguaugcguaugaguacuuguguguggcugguguaugggugagcaugcacauguguauggaugcauaugugagcuguacauguagaguguacauguguguugcaugagcaugcaugcgugcgagugccuguguguguacuugcauauauguggcugugcagguacccggcgguggugggcuggcagugcccggggaagcagguccugcucacggcuucccugcugggccccaggccccgggcugagccucccuggccccucuugccccucaguggagcagggccuggguggagggccugggcagcuccagggcagguccggggaggccaggcuuggggagcacagggggugggguucaccugcugcuguuuguucccgaaacuguacugugagcccacggcgggggcagauuguucugaggccccagaugugccaaaacagcccccagggugggggcgagcgaguucugaggagaggggcugcgggggccgggggugggugugugccccuccccugaauggcccccaaugcugcuguuuuucaauaaaaccagaguugaaggcaaaaaaaaaaaaaaaaaaaaaaaa

SEQ ID NO: 212 - RNA, 906 nt, Homo_Sapiens
uuuccgggacgucgcgcgccguguggggcgcgcacgcagggcugggcgugagggggcgugcgcgugcgcaggcgacgcgccgagguacuaggcagagccguggaaccgccgccaggucgcuguugguccacgccgcccgucgcgccgcccgcccgcucagcguccgccgccgccaugggagugcagguggaaaccaucuccccaggagacgggcgcaccuuccccaagcgcggccagaccugcguggugcacuacaccgggaugcuugaagauggaaagaaauuugauuccucccgggacagaaacaagcccuuuaaguuuaugcuaggcaagcaggaggugauccgaggcugggaagaagggguugcccagaugagugugggucagagagccaaacugacuauaucuccagauuaugccuauggugccacugggcacccaggcaucaucccaccacaugccacucucgucuucgauguggagcuucuaaaacuggaaugacaggaauggccuccucccuuagcucccuguucuuggguaaggaaauggaauacugaagggcccuucacugccuuugcuccucccauguuaugcccagcguuugauggguagcagagagaacaaaaaacaccacaaggcuauuuuucccccugcauucuuucuguauugaguauccuuucaguguuauuaguguaugcuuugaauguaaaaauuggucacccuaaggaaaggaauuggcauguguauguucccaguucaacucauggagauggcagcuguuuaaauguuuuucuauguaguuuauaaauuaaaacugaauugaggacuauggaaauguaggccaaauuuguagugccaacauuuuaguucuuuggaaauaagacucuuaaugaaugaaaaaaaaaa

SEQ ID NO: 213 - RNA, 1655 nt, Homo_Sapiens
uuuccgggacgucgcgcgccguguggggcgcgcacgcagggcugggcgugagggggcgugcgcgugcgcaggcgacgcgccgagguacuaggcagagccguggaaccgccgccaggucgcuguugguccacgccgcccgucgcgccgcccgcccgcucagcguccgccgccgccaugggagugcagguggaaaccaucuccccaggagacgggcgcaccuuccccaagcgcggccagaccugcguggugcacuacaccgggaugcuugaagauggaaagaaauuugauuccucccgggacagaaacaagcccuuuaaguuuaugcuaggcaagcaggaggugauccgaggcugggaagaagggguugcccagaugagugugggucagagagccaaacugacuauaucuccagauuaugccuauggugccacugggcacccaggcaucaucccaccacaugccacucucgucuucgauguggagcuucuaaaacuggaaugacaggaauggccuccucccuuagcucccuguucuuggaucugccauggagggaucuggugccuccagacaugugcacaugaauccauauggagcuuuuccugauguuccacuccacuuuguauagacaucugcccugacugaauguguucugucacucagcuuugcuuccgacaccucuguuuccucuuccccuuucuccucguauguguguuuaccuaaacuauaugccauaaaccucaaguuauucauuuuauuuuguuuucauuuuggggugaagauucaguuucagucuuuuggauauagguuuccaauuaaguacauggucaaguauuaacagcacaagugguagguuaacauuagaauaggaauugguguugggggggggguuugcaagaauauuuuauuuuaauuuuuuggaugaaauuuuuaucuauuauauauuaaacauucuugcugcugcgcugcaaagccauagcagauuugaggcgcuguugaggacugaauuacucuccaaguugagagaugucuuuggguuaaauuaaaagcccuaccuaaaacugagguggggauggggagagccuuugccuccaccauucccacccacccuccccuuaaacccucugccuuugaaaguagaucauguucacugcaaugcuggacacuacagguaucugucccugggccagcagggaccucugaagccuucuuuguggccuuuuuuuuuuuucauccugugguuuuucuaauggacuuucaggaauuuuguaaucucauaacuuuccaagcuccaccacuuccuaaaucuuaagaacuuuaauugacaguuucaauugaaggugcuguuuguagacuuaacacccagugaaagcccagccaucaugacaaauccuugaauguucucuuaagaaaaugaugcuggucaucgcagcuucagcaucuccuguuuuuugaugcuuggcucccucugcugaucucaguuuccuggcuuuuccucccucagccccuucucaccccuuugcuguccuguguagugauuuggugagaaaucguugcugcacccuucccccagcaccauuuaugagucucaaguuuuauuauugcaauaaaagugcuuuaugccggcuuuucucaaaaaaaaaaaaaaaaaaaaaaaa

SEQ ID NO: 214 - RNA, 3757 nt, Homo_Sapiens
aaucgcuccccgagccgcuccugacccaccuaccccagcucucgcgccgcgugcagaggugcucaagccuccucgcgguccgcagucagugccgccgcgcccggccucccgcacgccccgcagguagcgcccccgcccgcggcccagagugcgcucgcgccggcaccagcucccggauaaacggcgcgccgcgcggagaugacagccgaggagaugaaggcgaccgagagcggggcgcagucggcgccgcugcccauggagggaguggacaucagccccaaacaggacgaaggcgugcugaaggucaucaagagagagggcacagguacagagaugcccaugauuggggaccgagucuuuguccacuacacuggcuggcuauuagauggcacaaaguuugacuccagucuggaucgcaaggacaaauucuccuuugaccugggaaaaggggaggucaucaaggcuugggacauugccauagccaccaugaaggugggggaggugugccacaucaccugcaaaccagaauaugccuacgguucagcaggcaguccuccaaagauuccccccaaugccacgcuuguauuugagguggaguuguuugaguuuaagggagaagaucugacggaagaggaagauggcggaaucauucgcagaauacagacucgcggugaaggcuaugcuaagcccaaugagggugcuaucguggagguugcacuggaaggguacuacaaggacaagcucuuugaccagcgggagcuccgcuuugagauuggcgagggggagaaccuggaucugccuuauggucuggagagggccauucagcgcauggagaaaggagaacauuccaucguguaccucaagcccagcuaugcuuuuggcaguguugggaaggaaaaguuccaaaucccaccaaaugcugagcugaaauaugaauuacaccucaagaguuuugaaaaggccaaggagucuugggagaugaauucagaagagaagcuggaacagagcaccauagugaaagagcggggcacuguguacuucaaggaagguaaauacaagcaagcuuuacuacaguauaagaagaucgugucuuggcuggaauaugagucuaguuuuuccaaugaggaagcacagaaagcacaggcccuucgacuggccucucaccucaaccuggccaugugucaucugaaacuacaggccuucucugcugccauugaaagcuguaacaaggcccuagaacuggacagcaacaacgagaagggccucuuccgccggggagaggcccaccuggccgugaaugacuuugaacuggcacgggcugauuuccagaagguccugcagcucuaccccaacaacaaagccgccaagacccagcuggcugugugccagcagcggauccgaaggcagcuugcccgggagaagaagcucuaugccaauauguuugagaggcuggcugaggaggagaacaaggccaaggcagaggcuuccucaggagaccaucccacugacacagagaugaaggaggagcagaagagcaacacggcagggagccagucucagguggagacagaagcauagccccucuccaccagcccuacuccugcggcugccugccccccagucuccccacuccacccuguuaguuuuguaaaaacugaagaauuuugagugaauuagaccuuuauuuuucuaucugguuggaugguggcuuuaggggaagggggaaagguguaggcugggggauugagguggggaaucauuuuagcuggugucagccccucuucccuuccuccauugcacaugaacauauguccauccauauauauucaucagaauguuaauuuauuuugcucccucuguuagguccauuuucuaaggguagaagaggcaagugguagggaugaggucugauaagaacccaggguggagagggagacuccugggcagccguuuuccucauccuuucccucucccaguccauuuccaaauguggccuccaugugggugcuagggacaugggaaaaaccacugcuaugccauuucuucucucuguucccuuccucacccccgacgguguggcugaugaugucuucuggugucauggugaccacccccuguucccuguucugguauuuccccugucaguuuccccucucggccagguugugucccaaaauccccucagccucuucucugcacguugcugaagguccaggcuugccucaaguuccaugcuugagcaauaaaguggaaacaauaaaaccugggugucagacaacccuuucuguucagccuuggagugguggguauggguggguacauaauggguaguagcacaaucaaggggucacccacuuaguuccaguugagcuuaaauaagugagcaucucauguagaugccauaguugggcaggaagcagccccaccaugcauggcuuccugagcacugcacaggcugccgcugggauuugugucuauggcuucgcccaagguucccagcacucccucccuccagcaaccuggcaguuuuagugccucugguuuucuucccugacacuuaggaagacgaaaguauaaagaucuagaagacugggacaccaugcauguucauuuugaaguuggaauuggucuucugccuaccucugaucuggcagagguaucugcauuuugguuuguuaacaagguaaaacuccuggugucacugaccuccuccugucagauaacuuacaugauuaagguuaagaguaaagcagaguguucacguccagcuuccuucucagccuuaacaggaaaaggcuugugcuuuuuuucuaacuaugcuuugacccuuaacuccuauggcaugauggggcccugggagaagccaggcagcacaagccagucaugcugagcugccuccagauaauccuggcuccaggccagagcccgugucugcccucaucccucucuccuacugugagcucuccaguccuuucccaacagcgaugugguugucugcuuagccacaugccuguauaguuccuuccagaagaaauguauaaugguggaagauguauuucugugugaaaauuuucaccaagucauacaacacagcugaugcuggagccaggauuaaaauugggguguacaagucucccagugugaguaucccuugagcccaagacaccaaggaugcagagaacugugacugugccacugcacgccagccugggcaagagagugagaccaucucuuuuuuaaaaaagucccuguguaacugcuuucuuacugggcuuaccucacaucacagcccuguguuugugguuugugucuggguccucuugguauuucaaaaguaguagauucuuacgccugcagccaacaauaaucacuaacucaagcauuuauggaguaagccuagcacuguacugacagcaucacaugagugaaacugaauccuugcaaccauccuacaaagaagguauaacuuuaauaacccuauuuacagauaagaaaaccaagacucagaaguuaaauggaaaggugaggucucugaacuaauccagacucucccaugagguuccuuuggcaaguccugggcuucuguccucaucugcaaaaucgaaagcauuccugagguuucuuccagcucugcauccuguaggauuccaagaauguaaaacugcauguaaccguggaacaucuagagauaagucuuaguuuauguaacauuaaaacugucuagugaggauguuuuguuaaaaaaaaaaaaaaaaaa

SEQ ID NO: 215 - RNA, 9239 nt, Homo_Sapiens
gcgcuggcugcgggcggugagcugagcucgcccccggggagcuguggccggcgccccugccgguucccugagcagcggacguucaugcugggagggcggcggguuggaagcaggugccaccauggcuaguggcagcugucaggggugcgaagaggacgaggaaacucugaagaaguugauagucaggcugaacaauguccaggaaggaaaacagauagaaacgcugguccaaauccuggaggaucugcugguguucacguacuccgagcacgccuccaaguuauuucaaggcaaaaauauccaugugccucuguugaucgucuuggacuccuauaugagagucgcgagugugcagcagguggguuggucacuucugugcaaauuaauagaagucuguccagguacaaugcaaagcuuaaugggaccccaggauguuggaaaugauugggaaguccuugguguucaccaauugauucuuaaaaugcuaacaguucauaaugccaguguaaacuugucagugauuggacugaagaccuuagaucuccuccuaacuucagguaaaaucaccuugcugauauuggaugaagaaagugauauuuucauguuaauuuuugaugccaugcacucauuuccagccaaugaugaaguccagaaacuuggaugcaaagcuuuacaugugcuguuugagagagucucagaggagcaacugacugaauuuguugagaacaaagauuauaugauauuguuaagugcguuaacaaauuuuaaagaugaagaggaaauugugcuucaugugcugcauuguuuacauucccuagcgauuccuugcaauaauguggaaguccucaugaguggcaaugucagguguuauaauauugugguggaagcuaugaaagcauucccuaugagugaaagaauucaagaagugaguugcuguuugcuccauaggcuuacauuagguaauuuuuucaauauccugguauuaaacgaaguccaugaguuuguggugaaagcugugcagcaguacccagagaaugcagcauugcagaucucagcgcucagcuguuuggcccuccucacugagacuauuuucuuaaaucaagauuuagaggaaaagaaugagaaucaagagaaugaugaugagggggaagaagauaaauuguuuuggcuggaagccuguuacaaagcauuaacguggcauagaaagaacaagcacgugcaggaggccgcaugcugggcacuaaauaaucuccuuauguaccaaaacaguuuacaugagaagauuggagaugaagauggccauuucccagcucauagggaagugaugcucuccaugcugaugcauucuucaucaaaggaaguuuuccaggcaucugcgaaugcauugucaacucucuuagaacaaaauguuaauuucagaaaaauacuguuaucaaaaggaauacaccugaauguuuuggaguuaaugcagaagcauauacauucuccugaaguggcugaaaguggcuguaaaaugcuaaaucaucuuuuugaaggaagcaacacuucccuggauauaauggcagcagugguccccaaaauacuaacaguuaugaaacgucaugagacaucauuaccagugcagcuggaggcgcuucgagcuauuuuacauuuuauagugccuggcaugccagaagaauccagggaggauacagaauuucaucauaagcuaaauaugguuaaaaaacaguguuucaagaaugauauucacaaacugguccuagcagcuuugaacagguucauuggaaauccugggauucagaaauguggauuaaaaguaauuucuucuauuguacauuuuccugaugcauuagagauguuaucccuggaaggugcuauggauucagugcuucacacacugcagauguauccagaugaccaagaaauucagugucuggguuuaagucuuauaggauacuugauuacaaagaagaauguguucauaggaacuggacaucugcuggcaaaaauucugguuuccagcuuauaccgauuuaaggauguugcugaaauacagacuaaaggauuucagacaaucuuagcaauccucaaauugucagcaucuuuuucuaagcugcuggugcaucauucauuugacuuaguaauauuccaucaaaugucuuccaauaucauggaacaaaaggaucaacaguuucuaaaccucuguugcaaguguuuugcaaaaguagcuauggaugauuacuuaaaaaaugugaugcuagagagagcgugugaucagaauaacagcaucaugguugaaugcuugcuucuauugggagcagaugccaaucaagcaaaggagggaucuucuuuaauuugucagguaugugagaaagagagcagucccaaauugguggaacucuuacugaauaguggaucucgugaacaagauguacgaaaagcguugacgauaagcauugggaaaggugacagccagaucaucagcuugcucuuaaggaggcuggcccuggauguggccaacaauagcauuugccuuggaggauuuuguauaggaaaaguugaaccuucuuggcuugguccuuuauuuccagauaagacuucuaauuuaaggaaacaaacaaauauagcaucuacacuagcaagaauggugaucagauaucagaugaaaagugcuguggaagaaggaacagccucaggcagcgauggaaauuuuucugaagaugugcugucuaaauuugaugaauggaccuuuauuccugacucuucuauggacaguguguuugcucaaagugaugaccuggauagugaaggaagugaaggcucauuucuugugaaaaagaaaucuaauucaauuaguguaggagaauuuuaccgagaugccguauuacagcguugcucaccaaauuugcaaagacauuccaauuccuuggggcccauuuuugaucaugaagauuuacugaagcgaaaaagaaaaauauuaucuucagaugauucacucaggucaucaaaacuucaaucccauaugaggcauucagacagcauuucuucucuggcuucugagagagaauauauuacaucacuagaccuuucagcaaaugaacuaagagauauugaugcccuaagccagaaaugcuguauaaguguucauuuggagcaucuugaaaagcuggagcuucaccagaaugcacucacgagcuuuccacaacagcuaugugaaacucugaagaguuugacacauuuggacuugcacaguaauaaauuuacaucauuuccuucuuauuuguugaaaaugaguuguauugcuaaucuugaugucucucgaaaugacauuggacccucagugguuuuagauccuacagugaaauguccaacucugaaacaguuuaaccugucauauaaccagcugucuuuuguaccugagaaccucacugaugugguagagaaacuggagcagcucauuuuagaaggaaauaaaauaucagggauaugcucccccuugagacugaaggaacugaagauuuuaaaccuuaguaagaaccacauuucaucccuaucagagaacuuucuugaggcuuguccuaaaguggagaguuucagugccagaaugaauuuucuugcugcuaugccuuucuugccuccuucuaugacaauccuaaaauuaucucagaacaaauuuuccuguauuccagaagcaauuuuaaaucuuccacacuugcggucuuuagauaugagcagcaaugauauucaguaccuaccaggucccgcacacuggaaaucuuugaacuuaagggaacucuuauuuagccauaaucagaucagcaucuuggacuugagugaaaaagcauauuuauggucuagaguagagaaacugcaucuuucucacaauaaacugaaagagauuccuccugagauuggcugucuugaaaaucugacaucucuggaugucaguuacaacuuggaacuaagauccuuucccaaugaaauggggaaauuaagcaaaauaugggaucuuccuuuggaugaacugcaucuuaacuuugauuuuaaacauauaggauguaaagccaaagacaucauaagguuucuucaacagcgauuaaaaaaggcugugccuuauaaccgaaugaaacuuaugauugugggaaauacugggagugguaaaaccaccuuauugcagcaauuaaugaaaaccaagaaaucagaucuuggaaugcaaagugccacaguuggcauagaugugaaagacuggccuauccaaauaagagacaaaagaaagagagaucucguccuaaaugugugggauuuugcaggucgugaggaauucuauaguacucauccccauuuuaugacgcagcgagcauuguaccuugcugucuaugaccucagcaagggacaggcugaaguugaugccaugaagccuuggcucuucaauauaaaggcucgcgcuucuucuuccccugugauucucguuggcacacauuuggauguuucugaugagaagcaacgcaaagccugcaugaguaaaaucaccaaggaacuccugaauaagcgaggguucccugccauacgagauuaccacuuugugaaugccaccgaggaaucugaugcuuuggcaaaacuucggaaaaccaucauaaacgagagccuuaauuucaagauccgagaucagcuuguuguuggacagcugauuccagacugcuauguagaacuugaaaaaaucauuuuaucggagcguaaaaaugugccaauugaauuucccguaauugaccggaaacgauuauuacaacuagugagagaaaaucagcugcaguuagaugaaaaugagcuuccucacgcaguucacuuucuaaaugaaucaggaguccuucuucauuuucaagacccagcacugcaguuaagugacuuguacuuuguggaacccaaguggcuuuguaaaaucauggcacagauuuugacagugaaaguggaagguuguccaaaacacccuaagggcauuauuucgcguagagauguggaaaaauuucuuucaaaaaaaaggaaauuuccaaagaacuacaugucacaguauuuuaagcuccuagaaaaauuccagauugcuuugccaauaggagaagaauauuugcugguuccaagcaguuugucugaccacaggccugugauagagcuuccccauugugagaacucugaaauuaucauccgacuauaugaaaugccuuauuuuccaaugggauuuuggucaagauuaaucaaucgauuacuugagauuucaccuuacaugcuuucagggagagaacgagcacuucgcccaaacagaauguauuggcgacaaggcauuuacuuaaauuggucuccugaagcuuauugucugguaggaucugaagucuuagacaaucauccagagaguuucuuaaaaauuacaguuccuucuuguagaaaaggcuguauucuuuugggccaaguuguggaccacauugauucucucauggaagaaugguuuccuggguugcuggagauugauauuuguggugaaggagaaacucuguugaagaaaugggcauuauauaguuuuaaugauggugaagaacaucaaaaaaucuuacuugaugacuugaugaagaaagcagaggaaggagaucucuuaguaaauccagaucaaccaaggcucaccauuccaauaucucagauugccccugacuugauuuuggcugaccugccuagaaauauuauguugaauaaugaugaguuggaauuugaacaagcuccagaguuucuccuaggugauggcaguuuuggaucaguuuaccgagcagccuaugaaggagaagaaguggcugugaagauuuuuaauaaacauacaucacucaggcuguuaagacaagagcuuguggugcuuugccaccuccaccaccccaguuugauaucuuugcuggcagcugggauucguccccggauguuggugauggaguuagccuccaaggguuccuuggaucgccugcuucagcaggacaaagccagccucacuagaacccuacagcacaggauugcacuccacguagcugaugguuugagauaccuccacucagccaugauuauauaccgagaccugaaaccccacaaugugcugcuuuucacacuguaucccaaugcugccaucauugcaaagauugcugacuacggcauugcucaguacugcuguagaauggggauaaaaacaucagagggcacaccaggguuucgugcaccugaaguugccagaggaaaugucauuuauaaccaacaggcugauguuuauucauuugguuuacuacucuaugacauuuugacaacuggagguagaauaguagaggguuugaaguuuccaaaugaguuugaugaauuagaaauacaaggaaaauuaccugauccaguuaaagaauaugguugugccccauggccuaugguugagaaauuaauuaaacaguguuugaaagaaaauccucaagaaaggccuacuucugcccaggucuuugacauuuugaauucagcugaauuagucugucugacgagacgcauuuuauuaccuaaaaacguaauuguugaaugcaugguugcuacacaucacaacagcaggaaugcaagcauuuggcugggcugugggcacaccgacagaggacagcucucauuucuugacuuaaauacugaaggauacacuucugaggaaguugcugauaguagaauauugugcuuagccuuggugcaucuuccuguugaaaaggaaagcuggauugugucugggacacagucugguacucuccuggucaucaauaccgaagaugggaaaaagagacauacccuagaaaagaugacugauucugucacuuguuuguauugcaauuccuuuuccaagcaaagcaaacaaaaaaauuuucuuuugguuggaaccgcugauggcaaguuagcaauuuuugaagauaagacuguuaagcuuaaaggagcugcuccuuugaagauacuaaauauaggaaaugucaguacuccauugauguguuugagugaauccacaaauucaacggaaagaaauguaauguggggaggauguggcacaaagauuuucuccuuuucuaaugauuucaccauucagaaacucauugagacaagaacaagccaacuguuuucuuaugcagcuuucagugauuccaacaucauaacaguggugguagacacugcucucuauauugcuaagcaaaauagcccuguuguggaagugugggauaagaaaacugaaaaacucuguggacuaauagacugcgugcacuuuuuaagggagguaaugguaaaagaaaacaaggaaucaaaacacaaaaugucuuauucugggagagugaaaacccucugccuucagaagaacacugcucuuuggauaggaacuggaggaggccauauuuuacuccuggaucuuucaacucgucgacuuauacguguaauuuacaacuuuuguaauucggucagagucaugaugacagcacagcuaggaagccuuaaaaaugucaugcugguauugggcuacaaccggaaaaauacugaagguacacaaaagcagaaagagauacaaucuugcuugaccguuugggacaucaaucuuccacaugaagugcaaaauuuagaaaaacacauugaagugagaaaagaauuagcugaaaaaaugagacgaacaucuguugaguaagagagaaauaggaauugucuuuggauaggaaaauuauucucuccucuuguaaauauuuauuuuaaaaauguucacauggaaaggguacucacauuuuuugaaauagcucguguguaugaaggaauguuauuauuuuuaauuuaaauauauguaaaaauacuuaccaguaaauguguauuuuaaagaacuauuuaaaacacaauguuauauuucuuauaaauaccaguuacuuucguucauuaauuaaugaaaauaaaucugugaaguaccuaauuuaaguacucauacuaaaauuuauaaggccgauaauuuuuuguuuucuugucuguaauggagguaaacuuuauuuuaaauucugugcuuaagacaggacuauugcuugucgauuuuucuagaaaucugcacgguauaaugaaaauauuaagacaguuucccauguaauguauuccuucuuagauugcaucgaaaugcacuaucauauaugcuuguaaauauucaaaugaauuugcacuaauaaaguccuuuguugguaugugaauucucuuuguugcuguugcaaacagugcaucuuacacaacuucacucaauucaaaagaaaacuccauuaaaaguacuaaugaaaaaacaugacauacugucaaaguccucauaucuaggaaagacacagaaacucucuuugucacagaaacucucugugucuuuccuagacauaauagaguuguuuuucaacucuauguuugaauguggauacccugaauuuuguauaauuaguguaaauacaguguucaguccuucaagugauauuuuuauuuuuuuauucauaccacuagcuacuuguuuucuaaucugcuucauucuaaugcuuauauucaucuuuucccuaaauuugugaugcugcagauccuacaucauucagauagaaaccuuuuuuuuuuucagaauuauagaauuccacagcuccuaccaagaccaugaggauaaauaucuaacacuuuucaguugcugaaggagaaaggagcuuuaguuaugauggauaaaaauaucugccacccuaggcuuccaaauuauacuuaaauuguuuacauagcuuaccacaauaggaguaucagggccaaauaccuauguaauaauuugaggucauuucugcuuuaggaaaaguacuuucgguaaauucuuuggcccugaccaguauucauuauuucagauaauucccugugauaggacaacuaguacauuuaauauucucagaacuuauggcauuuuacuaugugaaaacuuuaaauuuauuuauauuaaggguaaucaaauucuuaaagaugaaagauuuucuguauuuuaaaggaagcuaugcuuuaacuuguuauguaauuaacaaaaaaaucauauauaauagagcucuuuguuccaguguuaucucuuucauuguuacuuuguauuugcaauuuuuuuuaccaaagacaaauuaaaaaaaugaauaccauauuuaaauggaauaauaaagguuuuuuaaaaacuuuaaaaaaaaaaaaaaaaa

SEQ ID NO: 216 - RNA, 5212 nt, Homo_Sapiens
guuauaguuuugccgcuggacucuucccucccuucccccaccccaucaggaugauaugagacuugaaagaagacgaugcauacaggaggagagacuucagcaugcaaaccuucaucuguucggcuugcaccgucauuuucauuccaugcugcuggccuucagauggcuggacagaugccccauucacaucaguacagugaccgucgccagccaaacauaagugaccaacagguuucugccuuaucauauucugaccagauucagcaaccucuaacuaaccaggugaugccugauauugucauguuacagaggcggaugccccaaaccuuccgugacccagcaacugcuccccugagaaaacuuucuguugacuugaucaaaacauacaagcauauuaaugagguuuacuaugcaaaaaagaagcgaagacaccaacagggccagggagacgauucuagucauaagaaggaacggaagguuuacaaugaugguuaugaugaugauaacuaugauuauauuguaaaaaacggagaaaaguggauggaucguuacgaaauugacuccuugauaggcaaagguuccuuuggacagguuguaaaggcauaugaucguguggagcaagaauggguugccauuaaaauaauaaagaacaagaaggcuuuucugaaucaagcacagauagaagugcgacuucuugagcucaugaacaaacaugacacugaaaugaaauacuacauagugcauuugaaacgccacuuuauguuucgaaaccaucucuguuuaguuuuugaaaugcuguccuacaaccucuaugacuugcugagaaacaccaauuuccgaggggucucuuugaaccuaacacgaaaguuugcgcaacagaugugcacugcacugcuuuuccuugcgacuccagaacuuaguaucauucacugugaucuaaaaccugaaaauauccuucuuuguaaccccaaacgcagugcaaucaagauaguugacuuuggcaguucuugucaguuggggcagaggauauaccaguauauucagagucgcuuuuaucggucuccagaggugcuacugggaaugccuuaugaccuugccauugauauguggucccucggguguauuuugguugaaaugcacacuggagaaccucuguucaguggugccaaugagguagaucagaugaauaaaauaguggaaguucuggguauuccaccugcucauauucuugaccaagcaccaaaagcaagaaaguucuuugagaaguugccagauggcacuuggaacuuaaagaagaccaaagauggaaaacgggaguacaaaccaccaggaacccguaaacuucauaacauucuuggaguggaaacaggaggaccuggugggcgacgugcuggggagucaggucauacggucgcugacuacuugaaguucaaagaccucauuuuaaggaugcuugauuaugaccccaaaacucgaauucaaccuuauuaugcucugcagcacaguuucuucaagaaaacagcugaugaagguacaaauacaaguaauaguguaucuacaagccccgccauggagcagucucagucuucgggcaccaccuccaguacaucgucaagcucagguggcucaucggggacaagcaacagugggagagcccggucggauccgacgcaccagcaucggcacaguggugggcacuucacagcugccgugcaggccauggacugcgagacacacaguccccaggugcgucagcaauuuccugcuccucuugguuggucaggcacugaagcuccuacacaggucacuguugaaacucauccuguucaagaaacaaccuuucauguagccccucaacagaaugcauugcaucaucaccaugguaacaguucccaucaccaucaccaccaccaccaccaucaccaccaccauggacaacaagccuuggguaaccggaccaggccaagggucuacaauucuccaacgaauagcuccucuacccaagauucuauggagguuggccacagucaccacuccaugacaucccugucuuccucaacgacuucuuccucgacaucuuccuccucuacugguaaccaaggcaaucaggccuaccagaaucgcccaguggcugcuaauaccuuggacuuuggacagaauggagcuauggacguuaauuugaccgucuacuccaauccccgccaagagacuggcauagcuggacauccaacauaccaauuuucugcuaauacagguccugcacauuacaugacugaaggacaucugacaaugaggcaaggggcugauagagaagagucccccaugacaggaguuugugugcaacagaguccuguagcuagcucgugacuacauugaaacuugaguuuguuucuuguguguuuuuauagaagugguguuuuuuuuccaaaaacaaagugcaaagcugcuugaaucaggaggagauuaacacacugaaccgcuacaagagggcaaagcugauuuuuuuuuuaacuugaaaagauugcaaagggacauugaaguguuuaaaagagccauguccaaacccaucuucauggauagcucagagguauccucuuuuugcucccccauuuuaacuugccacaucccagucacagugggguuuuuuugucuuucuauucagcaaaaguuaauauucagauguuggucuuggucauuugccaacuaauuuuaaaguaaaaggcacugcacauaauuugcauaaagggccccaugaggguguuuuuuuuuuuucuuuuugucccccccaucccccuuuuuuuuuguuuuguucuguuuuguuuugggugggagggugggaaauuuggguuuuuaaguccucuaaacacacuugggcacggaaaugcaguacuguaaggaagagggaccuccagcuuccacaaacaccaucuucagcuguaugaaagggacgguuguggugaaguuugucaggcacaguaagcaugcugaguggcggggaucagaacucuccuaucugaaccuacugaggagcaaagcagcaauuacaugggauccuguggcucucccguugcagaggccacaggaagauaggauggaacgugacuggucuccuaaccaaggugcacugagaagcaaucaacgggucggucguggccaguccuggggaggucugagugguggucuuugggauaaccuuuggccuuauggauuuggacucgaaauuagaagagccuaccauuucagaugcaaucacuuuuggacaugcuuuugcagacaguccuuaaugcugaaaacacagagaauggguaauucaagaggccuuucuuuuaaaauagacuuuugugacccacuaauuguaagguauugcaaggucacuuugcgugugucauaaaguugacuuccuuauugguugaaggucacagaaguagugguuugcuuugauggaaauagcuacagcugugucccuuccugcuuuuuacuuuuucuuuugcuuuuucucggcacgugguaucuccaccauuucuucugcacaaagaugucuucuguucauccugaacauuuuuaaaaaaugcagaauuuuaugugacugcuuuuuugccucacaauuaugcugugaauuuuacaaaaauuuauuuucuuuuuugauaauuuauuguaccaaagcuguuuuuauagcacauagaugucuguaaccaauaauguagcaguucugcacuuugacacaagguguaacuagaccauuuuuaaaugucaguugaaaauuauggcuguacuauugcuuaaacaaaacuggaacuguuguugaauccauagccaauacauuuacagcaaucuguguacugaacauaguagauugacaucuaauucaagauuacaacaucuguuacauucuaaguguguucaggcuucugaagguaaagggacacuggauccagaagcuauggaaccagcaguugauucuuguauuccugauuaaccuacuuguaaacuugaaagcaagaccuugauugcaccaacagguccagaguaugagugcaagcaaagcagaacucucaugcgugaccugagcagacaggcugguauuuaacaggugccucguguugagauuacgcugccuuaauguaacacagucuggcaguugcuaaauuuguguucccauuuuaaauugaccaauuuuggggugugacacuuuugagcgguugaauugggagaaugaagauaaguaauuuaccuguccaggaucaaaagaagccuagaaaagaagcaguaaucuaccucugccgauaaccuguuuaagaugacucagcagaacaccgcguuucauucuauuggucaauuccauguggcugacuaggucaauuuuuuuucugaacaaaagcagguuuuuauauguaaacagugagaaaagaaaggcuaaacacuauguaaaugugaauggaaacuuggaaauacucguuuuuauaaacuacaaaaacuuuuuguuguuuaucaggaaauccauauuuauuuuguaauuaacugucaagccuguggaugauuuuuuugaacuugguaguucauaaagguuuacagugaauaaaaggauaucaucuugaguauagcaauaucaaaaggaauucaguaguuacugcuguuuaggaauauaagguuaagauaucauaugggucaggucauuuuuuuuuucugugcugguugccacaucuuagcaagcaccaaaaaacuaaagcaguuuuuaaaccgauauuuacguaaagaaaaucauaaaauccaaugcuucugcauacuguguuauguuacaguccaguuuugugugcuuuacuacacaguuugguuacaggacuucugugcauuguaaacauaaacagcauggaaaagguuaaauaccuguguucagauuguaagaucuaguccggacuugcuguguauauuguaacguuaaaugaaaaaagaaccccccuuuguauuauagucaugcggucuuauguaugauaaacaguugaauaauuuguccucagacucuuuacuaugcuuuuuuaaaaauuaauuuaagaaaaauguaaacauaguaaaaaucuuccuaugcaauuaaacugguccaggucugguagguauaguaucaaaguugaguuaaauguguaaaaaggaaacuauuugagauacauugacauaggcaucagcaaucucugaaaguaaaaauuggagguuuaacaga

SEQ ID NO: 217 - RNA, 6580 nt, Homo_Sapiens
aaaaauaacucauauugucucugagguucuuuuccagugaaguguuuaguauugcugcuauuuggaguacaaaguuggagcuuuuaaagaaccugggaguucaaaaguauaaggagaaauaaaugaaaagcagaaauauuuugaggcaauaaguauagacucaaaucuauauuaugacccacuuguagcaccacuuggaauucuaccaauaagagauuuauuugggcaaacuauaaugguuguuggaaauugcaaaucuuagugugaauuauuuuaguccaguugguuucuuucuuucucuuaccugaaaugaacuauacugaggcaauaggagcuuuguauaguaauuuaggaguguaaaacaacuuagggaaaaggauuauuaagcaggaugauugggaugacaucaugugaaauuuaggaauuggaggcauugggaauugagagggugcuaacaaaggaaaacagcuuauuuuagaauuugucuggaggauguagaauugaagaaguuuugguauuucuucugcagcggccccagugcccuugaccaggaacaucucuuggagucaguaguuuucaugaggcugaccuaggaacuuggccaacauaugcaacauuguucuauuuaaaauauuccuugaauuaaauucgauaguaucaauuuaaaacauaaaguuuucacucaacuccuuuagaaguuagauuuuagcuuguacuugucuuuaccucuucugcugauuaucaguugacaacacugagauuacuuucauuuuccuguaagucauuaugaauuuuucuggucaaccaugaguuaucaguggaagcaauaaguaggaaguacuguaaaagaauuacaauaaaauaagagaaaccacuuggagagcaagagggcuuguggacuugggggagcgguugugagaaaugucucagaacuuaauuuacaaauaacauugguagauugacauguugucuuuccuauaaaguaacuuuaccucugucuuaauaguaaacuacuaugaaagugaauucguguuccucuugauuugugaacugaugaaaauuacaaaauguggaguuuuuuccccagauaaaguaaaugguggaauauucagguuuauuugauaccuagaaaauaccugaaauuuuccgugguaauaggcacauuuugaaacuguuuuuuuuuucucugacaauugaauauauuuuauauauaguugauuuugauuauugaagacuaaggaaaauuuaaguuugaauguuagaaaaugaauuuugcaaauuugaaguaauuuuauucuuuauguuuugggauuguaguuauguuagauauuccucaguugggguaauugucuugcaucauuaucucuuaucauaaucuguuuuucuucacacaguguuauaguuuugccgcuggacucuucccucccuucccccaccccaucaggaugauaugagacuugaaagaagacgaugcauacaggaggagagacuucagcaugcaaaccuucaucuguucggcuugcaccgucauuuucauuccaugcugcuggccuucagauggcuggacagaugccccauucacaucaguacagugaccgucgccagccaaacauaagugaccaacagguuucugccuuaucauauucugaccagauucagcaaccucuaacuaaccagaggcggaugccccaaaccuuccgugacccagcaacugcuccccugagaaaacuuucuguugacuugaucaaaacauacaagcauauuaaugagguuuacuaugcaaaaaagaagcgaagacaccaacagggccagggagacgauucuagucauaagaaggaacggaagguuuacaaugaugguuaugaugaugauaacuaugauuauauuguaaaaaacggagaaaaguggauggaucguuacgaaauugacuccuugauaggcaaagguuccuuuggacagguuguaaaggcauaugaucguguggagcaagaauggguugccauuaaaauaauaaagaacaagaaggcuuuucugaaucaagcacagauagaagugcgacuucuugagcucaugaacaaacaugacacugaaaugaaauacuacauagugcauuugaaacgccacuuuauguuucgaaaccaucucuguuuaguuuuugaaaugcuguccuacaaccucuaugacuugcugagaaacaccaauuuccgaggggucucuuugaaccuaacacgaaaguuugcgcaacagaugugcacugcacugcuuuuccuugcgacuccagaacuuaguaucauucacugugaucuaaaaccugaaaauauccuucuuuguaaccccaaacgcagugcaaucaagauaguugacuuuggcaguucuugucaguuggggcagaggauauaccaguauauucagagucgcuuuuaucggucuccagaggugcuacugggaaugccuuaugaccuugccauugauauguggucccucggguguauuuugguugaaaugcacacuggagaaccucuguucaguggugccaaugagguagaucagaugaauaaaauaguggaaguucuggguauuccaccugcucauauucuugaccaagcaccaaaagcaagaaaguucuuugagaaguugccagauggcacuuggaacuuaaagaagaccaaagauggaaaacgggaguacaaaccaccaggaacccguaaacuucauaacauucuuggaguggaaacaggaggaccuggugggcgacgugcuggggagucaggucauacggucgcugacuacuugaaguucaaagaccucauuuuaaggaugcuugauuaugaccccaaaacucgaauucaaccuuauuaugcucugcagcacaguuucuucaagaaaacagcugaugaagguacaaauacaaguaauaguguaucuacaagccccgccauggagcagucucagucuucgggcaccaccuccaguacaucgucaagcucagguggcucaucggggacaagcaacagugggagagcccggucggauccgacgcaccagcaucggcacaguggugggcacuucacagcugccgugcaggccauggacugcgagacacacaguccccaggugcgucagcaauuuccugcuccucuugguuggucaggcacugaagcuccuacacaggucacuguugaaacucauccuguucaagaaacaaccuuucauguagccccucaacagaaugcauugcaucaucaccaugguaacaguucccaucaccaucaccaccaccaccaccaucaccaccaccauggacaacaagccuuggguaaccggaccaggccaagggucuacaauucuccaacgaauagcuccucuacccaagauucuauggagguuggccacagucaccacuccaugacaucccugucuuccucaacgacuucuuccucgacaucuuccuccucuacugguaaccaaggcaaucaggccuaccagaaucgcccaguggcugcuaauaccuuggacuuuggacagaauggagcuauggacguuaauuugaccgucuacuccaauccccgccaagagacuggcauagcuggacauccaacauaccaauuuucugcuaauacagguccugcacauuacaugacugaaggacaucugacaaugaggcaaggggcugauagagaagagucccccaugacaggaguuugugugcaacagaguccuguagcuagcucgugacuacauugaaacuugaguuuguuucuuguguguuuuuauagaagugguguuuuuuuuccaaaaacaaagugcaaagcugcuugaaucaggaggagauuaacacacugaaccgcuacaagagggcaaagcugauuuuuuuuuuaacuugaaaagauugcaaagggacauugaaguguuuaaaagagccauguccaaacccaucuucauggauagcucagagguauccucuuuuugcucccccauuuuaacuugccacaucccagucacagugggguuuuuuugucuuucuauucagcaaaaguuaauauucagauguuggucuuggucauuugccaacuaauuuuaaaguaaaaggcacugcacauaauuugcauaaagggccccaugaggguguuuuuuuuuuuucuuuuugucccccccaucccccuuuuuuuuuguuuuguucuguuuuguuuugggugggagggugggaaauuuggguuuuuaaguccucuaaacacacuugggcacggaaaugcaguacuguaaggaagagggaccuccagcuuccacaaacaccaucuucagcuguaugaaagggacgguuguggugaaguuugucaggcacaguaagcaugcugaguggcggggaucagaacucuccuaucugaaccuacugaggagcaaagcagcaauuacaugggauccuguggcucucccguugcagaggccacaggaagauaggauggaacgugacuggucuccuaaccaaggugcacugagaagcaaucaacgggucggucguggccaguccuggggaggucugagugguggucuuugggauaaccuuuggccuuauggauuuggacucgaaauuagaagagccuaccauuucagaugcaaucacuuuuggacaugcuuuugcagacaguccuuaaugcugaaaacacagagaauggguaauucaagaggccuuucuuuuaaaauagacuuuugugacccacuaauuguaagguauugcaaggucacuuugcgugugucauaaaguugacuuccuuauugguugaaggucacagaaguagugguuugcuuugauggaaauagcuacagcugugucccuuccugcuuuuuacuuuuucuuuugcuuuuucucggcacgugguaucuccaccauuucuucugcacaaagaugucuucuguucauccugaacauuuuuaaaaaaugcagaauuuuaugugacugcuuuuuugccucacaauuaugcugugaauuuuacaaaaauuuauuuucuuuuuugauaauuuauuguaccaaagcuguuuuuauagcacauagaugucuguaaccaauaauguagcaguucugcacuuugacacaagguguaacuagaccauuuuuaaaugucaguugaaaauuauggcuguacuauugcuuaaacaaaacuggaacuguuguugaauccauagccaauacauuuacagcaaucuguguacugaacauaguagauugacaucuaauucaagauuacaacaucuguuacauucuaaguguguucaggcuucugaagguaaagggacacuggauccagaagcuauggaaccagcaguugauucuuguauuccugauuaaccuacuuguaaacuugaaagcaagaccuugauugcaccaacagguccagaguaugagugcaagcaaagcagaacucucaugcgugaccugagcagacaggcugguauuuaacaggugccucguguugagauuacgcugccuuaauguaacacagucuggcaguugcuaaauuuguguucccauuuuaaauugaccaauuuuggggugugacacuuuugagcgguugaauugggagaaugaagauaaguaauuuaccuguccaggaucaaaagaagccuagaaaagaagcaguaaucuaccucugccgauaaccuguuuaagaugacucagcagaacaccgcguuucauucuauuggucaauuccauguggcugacuaggucaauuuuuuuucugaacaaaagcagguuuuuauauguaaacagugagaaaagaaaggcuaaacacuauguaaaugugaauggaaacuuggaaauacucguuuuuauaaacuacaaaaacuuuuuguuguuuaucaggaaauccauauuuauuuuguaauuaacugucaagccuguggaugauuuuuuugaacuugguaguucauaaagguuuacagugaauaaaaggauaucaucuugaguauagcaauaucaaaaggaauucaguaguuacugcuguuuaggaauauaagguuaagauaucauaugggucaggucauuuuuuuuuucugugcugguugccacaucuuagcaagcaccaaaaaacuaaagcaguuuuuaaaccgauauuuacguaaagaaaaucauaaaauccaaugcuucugcauacuguguuauguuacaguccaguuuugugugcuuuacuacacaguuugguuacaggacuucugugcauuguaaacauaaacagcauggaaaagguuaaauaccuguguucagauuguaagaucuaguccggacuugcuguguauauuguaacguuaaaugaaaaaagaaccccccuuuguauuauagucaugcggucuuauguaugauaaacaguugaauaauuuguccucagacucuuuacuaugcuuuuuuaaaaauuaauuuaagaaaaauguaaacauaguaaaaaucuuccuaugcaauuaaacugguccaggucugguagguauaguaucaaaguugaguuaaauguguaaaaaggaaacuauuugagauacauugacauaggcaucagcaaucucugaaaguaaaaauuggagguuuaacaga

SEQ ID NO: 218 - RNA, 5517 nt, Homo_Sapiens
gggagcgcggcgcgggagcccgaggcugagacucaccggaggaagcggcgcgagcgccccgccaucgucccggcugaagugcaguggcacgaucauagguggucacuacagucucagauuccugggcuuaagcagucuucccaccucagccuccccaguagcugggauuacaguguuauaguuuugccgcuggacucuucccucccuucccccaccccaucaggaugauaugagacuugaaagaagacgaugcauacaggaggagagacuucagcaugcaaaccuucaucuguucggcuugcaccgucauuuucauuccaugcugcuggccuucagauggcuggacagaugccccauucacaucaguacagugaccgucgccagccaaacauaagugaccaacagguuucugccuuaucauauucugaccagauucagcaaccucuaacuaaccaggugaugccugauauugucauguuacagaggcggaugccccaaaccuuccgugacccagcaacugcuccccugagaaaacuuucuguugacuugaucaaaacauacaagcauauuaaugagguuuacuaugcaaaaaagaagcgaagacaccaacagggccagggagacgauucuagucauaagaaggaacggaagguuuacaaugaugguuaugaugaugauaacuaugauuauauuguaaaaaacggagaaaaguggauggaucguuacgaaauugacuccuugauaggcaaagguuccuuuggacagguuguaaaggcauaugaucguguggagcaagaauggguugccauuaaaauaauaaagaacaagaaggcuuuucugaaucaagcacagauagaagugcgacuucuugagcucaugaacaaacaugacacugaaaugaaauacuacauagugcauuugaaacgccacuuuauguuucgaaaccaucucuguuuaguuuuugaaaugcuguccuacaaccucuaugacuugcugagaaacaccaauuuccgaggggucucuuugaaccuaacacgaaaguuugcgcaacagaugugcacugcacugcuuuuccuugcgacuccagaacuuaguaucauucacugugaucuaaaaccugaaaauauccuucuuuguaaccccaaacgcagugcaaucaagauaguugacuuuggcaguucuugucaguuggggcagaggauauaccaguauauucagagucgcuuuuaucggucuccagaggugcuacugggaaugccuuaugaccuugccauugauauguggucccucggguguauuuugguugaaaugcacacuggagaaccucuguucaguggugccaaugagguagaucagaugaauaaaauaguggaaguucuggguauuccaccugcucauauucuugaccaagcaccaaaagcaagaaaguucuuugagaaguugccagauggcacuuggaacuuaaagaagaccaaagauggaaaacgggaguacaaaccaccaggaacccguaaacuucauaacauucuuggaguggaaacaggaggaccuggugggcgacgugcuggggagucaggucauacggucgcugacuacuugaaguucaaagaccucauuuuaaggaugcuugauuaugaccccaaaacucgaauucaaccuuauuaugcucugcagcacaguuucuucaagaaaacagcugaugaagguacaaauacaaguaauaguguaucuacaagccccgccauggagcagucucagucuucgggcaccaccuccaguacaucgucaagcucagguggcucaucggggacaagcaacagugggagagcccggucggauccgacgcaccagcaucggcacaguggugggcacuucacagcugccgugcaggccauggacugcgagacacacaguccccaggugagcucgcacgugguucauuugcuugugucaccugccauucucagguggagcagcacuggaugccaggugccuuuagaaugaccguaucauuuacccuagagguucaugacguuccugucuaaggaaaugugcgucagcaauuuccugcuccucuugguuggucaggcacugaagcuccuacacaggucacuguugaaacucauccuguucaagaaacaaccuuucauguagccccucaacagaaugcauugcaucaucaccaugguaacaguucccaucaccaucaccaccaccaccaccaucaccaccaccauggacaacaagccuuggguaaccggaccaggccaagggucuacaauucuccaacgaauagcuccucuacccaagauucuauggagguuggccacagucaccacuccaugacaucccugucuuccucaacgacuucuuccucgacaucuuccuccucuacugguaaccaaggcaaucaggccuaccagaaucgcccaguggcugcuaauaccuuggacuuuggacagaauggagcuauggacguuaauuugaccgucuacuccaauccccgccaagagacuggcauagcuggacauccaacauaccaauuuucugcuaauacagguccugcacauuacaugacugaaggacaucugacaaugaggcaaggggcugauagagaagagucccccaugacaggaguuugugugcaacagaguccuguagcuagcucgugacuacauugaaacuugaguuuguuucuuguguguuuuuauagaagugguguuuuuuuuccaaaaacaaagugcaaagcugcuugaaucaggaggagauuaacacacugaaccgcuacaagagggcaaagcugauuuuuuuuuuaacuugaaaagauugcaaagggacauugaaguguuuaaaagagccauguccaaacccaucuucauggauagcucagagguauccucuuuuugcucccccauuuuaacuugccacaucccagucacagugggguuuuuuugucuuucuauucagcaaaaguuaauauucagauguuggucuuggucauuugccaacuaauuuuaaaguaaaaggcacugcacauaauuugcauaaagggccccaugaggguguuuuuuuuuuuucuuuuugucccccccaucccccuuuuuuuuuguuuuguucuguuuuguuuugggugggagggugggaaauuuggguuuuuaaguccucuaaacacacuugggcacggaaaugcaguacuguaaggaagagggaccuccagcuuccacaaacaccaucuucagcuguaugaaagggacgguuguggugaaguuugucaggcacaguaagcaugcugaguggcggggaucagaacucuccuaucugaaccuacugaggagcaaagcagcaauuacaugggauccuguggcucucccguugcagaggccacaggaagauaggauggaacgugacuggucuccuaaccaaggugcacugagaagcaaucaacgggucggucguggccaguccuggggaggucugagugguggucuuugggauaaccuuuggccuuauggauuuggacucgaaauuagaagagccuaccauuucagaugcaaucacuuuuggacaugcuuuugcagacaguccuuaaugcugaaaacacagagaauggguaauucaagaggccuuucuuuuaaaauagacuuuugugacccacuaauuguaagguauugcaaggucacuuugcgugugucauaaaguugacuuccuuauugguugaaggucacagaaguagugguuugcuuugauggaaauagcuacagcugugucccuuccugcuuuuuacuuuuucuuuugcuuuuucucggcacgugguaucuccaccauuucuucugcacaaagaugucuucuguucauccugaacauuuuuaaaaaaugcagaauuuuaugugacugcuuuuuugccucacaauuaugcugugaauuuuacaaaaauuuauuuucuuuuuugauaauuuauuguaccaaagcuguuuuuauagcacauagaugucuguaaccaauaauguagcaguucugcacuuugacacaagguguaacuagaccauuuuuaaaugucaguugaaaauuauggcuguacuauugcuuaaacaaaacuggaacuguuguugaauccauagccaauacauuuacagcaaucuguguacugaacauaguagauugacaucuaauucaagauuacaacaucuguuacauucuaaguguguucaggcuucugaagguaaagggacacuggauccagaagcuauggaaccagcaguugauucuuguauuccugauuaaccuacuuguaaacuugaaagcaagaccuugauugcaccaacagguccagaguaugagugcaagcaaagcagaacucucaugcgugaccugagcagacaggcugguauuuaacaggugccucguguugagauuacgcugccuuaauguaacacagucuggcaguugcuaaauuuguguucccauuuuaaauugaccaauuuuggggugugacacuuuugagcgguugaauugggagaaugaagauaaguaauuuaccuguccaggaucaaaagaagccuagaaaagaagcaguaaucuaccucugccgauaaccuguuuaagaugacucagcagaacaccgcguuucauucuauuggucaauuccauguggcugacuaggucaauuuuuuuucugaacaaaagcagguuuuuauauguaaacagugagaaaagaaaggcuaaacacuauguaaaugugaauggaaacuuggaaauacucguuuuuauaaacuacaaaaacuuuuuguuguuuaucaggaaauccauauuuauuuuguaauuaacugucaagccuguggaugauuuuuuugaacuugguaguucauaaagguuuacagugaauaaaaggauaucaucuugaguauagcaauaucaaaaggaauucaguaguuacugcuguuuaggaauauaagguuaagauaucauaugggucaggucauuuuuuuuuucugugcugguugccacaucuuagcaagcaccaaaaaacuaaagcaguuuuuaaaccgauauuuacguaaagaaaaucauaaaauccaaugcuucugcauacuguguuauguuacaguccaguuuugugugcuuuacuacacaguuugguuacaggacuucugugcauuguaaacauaaacagcauggaaaagguuaaauaccuguguucagauuguaagaucuaguccggacuugcuguguauauuguaacguuaaaugaaaaaagaaccccccuuuguauuauagucaugcggucuuauguaugauaaacaguugaauaauuuguccucagacucuuuacuaugcuuuuuuaaaaauuaauuuaagaaaaauguaaacauaguaaaaaucuuccuaugcaauuaaacugguccaggucugguagguauaguaucaaaguugaguuaaauguguaaaaaggaaacuauuugagauacauugacauaggcaucagcaaucucugaaaguaaaaauuggagguuuaacaga

SEQ ID NO: 219 - RNA, 5088 nt, Homo_Sapiens
uguuauaguuuugccgcuggacucuucccucccuucccccaccccaucaggaugauaugagacuugaaagaagacgaugcauacaggaggagagacuucagcaugcaaaccuucaucuguucggcuugcaccgucauuuucauuccaugcugcuggccuucagauggcuggacagaugccccauucacaucaguacagugaccgucgccagccaaacauaagugaccaacagguuucugccuuaucauauucugaccagauucagcaaccucuaacuaaccaggugaugccugauauugucauguuacagaggcggaugccccaaaccuuccgugacccagcaacugcuccccugagaaaacuuucuguugacuugaucaaaacauacaagcauauuaaugagguuuacuaugcaaaaaagaagcgaagacaccaacagggccagggagacgauucuagucauaagaaggaacggaagguuuacaaugaugguuaugaugaugauaacuaugauuauauuguaaaaaacggagaaaaguggauggaucguuacgaaauugacuccuugauaggcaaagguuccuuuggacagguuguaaaggcauaugaucguguggagcaagaauggguugccauuaaaauaauaaagaacaagaaggcuuuucugaaucaagcacagauagaagugcgacuucuugagcucaugaacaaacaugacacugaaaugaaauacuacauagugcauuugaaacgccacuuuauguuucgaaaccaucucuguuuaguuuuugaaaugcuguccuacaaccucuaugacuugcugagaaacaccaauuuccgaggggucucuuugaaccuaacacgaaaguuugcgcaacagaugugcacugcacugcuuuuccuugcgacuccagaacuuaguaucauucacugugaucuaaaaccugaaaauauccuucuuuguaaccccaaacgcagugcaaucaagauaguugacuuuggcaguucuugucaguuggggcagaggauauaccaguauauucagagucgcuuuuaucggucuccagaggugcuacugggaaugccuuaugaccuugccauugauauguggucccucggguguauuuugguugaaaugcacacuggagaaccucuguucaguggugccaaugagguagaucagaugaauaaaauaguggaaguucuggguauuccaccugcucauauucuugaccaagcaccaaaagcaagaaaguucuuugagaaguugccagauggcacuuggaacuuaaagaagaccaaagauggaaaacgggaguacaaaccaccaggaacccguaaacuucauaacauucuuggaguggaaacaggaggaccuggugggcgacgugcuggggagucaggucauacggucgcugacuacuugaaguucaaagaccucauuuuaaggaugcuugauuaugaccccaaaacucgaauucaaccuuauuaugcucugcagcacaguuucuucaagaaaacagcugaugaagguacaaauacaaguaauaguguaucuacaagccccgccauggagcagucucagucuucgggcaccaccuccaguacaucgucaagcucaggugcgucagcaauuuccugcuccucuugguuggucaggcacugaagcuccuacacaggucacuguugaaacucauccuguucaagaaacaaccuuucauguagccccucaacagaaugcauugcaucaucaccaugguaacaguucccaucaccaucaccaccaccaccaccaucaccaccaccauggacaacaagccuuggguaaccggaccaggccaagggucuacaauucuccaacgaauagcuccucuacccaagauucuauggagguuggccacagucaccacuccaugacaucccugucuuccucaacgacuucuuccucgacaucuuccuccucuacugguaaccaaggcaaucaggccuaccagaaucgcccaguggcugcuaauaccuuggacuuuggacagaauggagcuauggacguuaauuugaccgucuacuccaauccccgccaagagacuggcauagcuggacauccaacauaccaauuuucugcuaauacagguccugcacauuacaugacugaaggacaucugacaaugaggcaaggggcugauagagaagagucccccaugacaggaguuugugugcaacagaguccuguagcuagcucgugacuacauugaaacuugaguuuguuucuuguguguuuuuauagaagugguguuuuuuuuccaaaaacaaagugcaaagcugcuugaaucaggaggagauuaacacacugaaccgcuacaagagggcaaagcugauuuuuuuuuuaacuugaaaagauugcaaagggacauugaaguguuuaaaagagccauguccaaacccaucuucauggauagcucagagguauccucuuuuugcucccccauuuuaacuugccacaucccagucacagugggguuuuuuugucuuucuauucagcaaaaguuaauauucagauguuggucuuggucauuugccaacuaauuuuaaaguaaaaggcacugcacauaauuugcauaaagggccccaugaggguguuuuuuuuuuuucuuuuugucccccccaucccccuuuuuuuuuguuuuguucuguuuuguuuugggugggagggugggaaauuuggguuuuuaaguccucuaaacacacuugggcacggaaaugcaguacuguaaggaagagggaccuccagcuuccacaaacaccaucuucagcuguaugaaagggacgguuguggugaaguuugucaggcacaguaagcaugcugaguggcggggaucagaacucuccuaucugaaccuacugaggagcaaagcagcaauuacaugggauccuguggcucucccguugcagaggccacaggaagauaggauggaacgugacuggucuccuaaccaaggugcacugagaagcaaucaacgggucggucguggccaguccuggggaggucugagugguggucuuugggauaaccuuuggccuuauggauuuggacucgaaauuagaagagccuaccauuucagaugcaaucacuuuuggacaugcuuuugcagacaguccuuaaugcugaaaacacagagaauggguaauucaagaggccuuucuuuuaaaauagacuuuugugacccacuaauuguaagguauugcaaggucacuuugcgugugucauaaaguugacuuccuuauugguugaaggucacagaaguagugguuugcuuugauggaaauagcuacagcugugucccuuccugcuuuuuacuuuuucuuuugcuuuuucucggcacgugguaucuccaccauuucuucugcacaaagaugucuucuguucauccugaacauuuuuaaaaaaugcagaauuuuaugugacugcuuuuuugccucacaauuaugcugugaauuuuacaaaaauuuauuuucuuuuuugauaauuuauuguaccaaagcuguuuuuauagcacauagaugucuguaaccaauaauguagcaguucugcacuuugacacaagguguaacuagaccauuuuuaaaugucaguugaaaauuauggcuguacuauugcuuaaacaaaacuggaacuguuguugaauccauagccaauacauuuacagcaaucuguguacugaacauaguagauugacaucuaauucaagauuacaacaucuguuacauucuaaguguguucaggcuucugaagguaaagggacacuggauccagaagcuauggaaccagcaguugauucuuguauuccugauuaaccuacuuguaaacuugaaagcaagaccuugauugcaccaacagguccagaguaugagugcaagcaaagcagaacucucaugcgugaccugagcagacaggcugguauuuaacaggugccucguguugagauuacgcugccuuaauguaacacagucuggcaguugcuaaauuuguguucccauuuuaaauugaccaauuuuggggugugacacuuuugagcgguugaauugggagaaugaagauaaguaauuuaccuguccaggaucaaaagaagccuagaaaagaagcaguaaucuaccucugccgauaaccuguuuaagaugacucagcagaacaccgcguuucauucuauuggucaauuccauguggcugacuaggucaauuuuuuuucugaacaaaagcagguuuuuauauguaaacagugagaaaagaaaggcuaaacacuauguaaaugugaauggaaacuuggaaauacucguuuuuauaaacuacaaaaacuuuuuguuguuuaucaggaaauccauauuuauuuuguaauuaacugucaagccuguggaugauuuuuuugaacuugguaguucauaaagguuuacagugaauaaaaggauaucaucuugaguauagcaauaucaaaaggaauucaguaguuacugcuguuuaggaauauaagguuaagauaucauaugggucaggucauuuuuuuuuucugugcugguugccacaucuuagcaagcaccaaaaaacuaaagcaguuuuuaaaccgauauuuacguaaagaaaaucauaaaauccaaugcuucugcauacuguguuauguuacaguccaguuuugugugcuuuacuacacaguuugguuacaggacuucugugcauuguaaacauaaacagcauggaaaagguuaaauaccuguguucagauuguaagaucuaguccggacuugcuguguauauuguaacguuaaaugaaaaaagaaccccccuuuguauuauagucaugcggucuuauguaugauaaacaguugaauaauuuguccucagacucuuuacuaugcuuuuuuaaaaauuaauuuaagaaaaauguaaacauaguaaaaaucuuccuaugcaauuaaacugguccaggucugguagguauaguaucaaaguugaguuaaauguguaaaaaggaaacuauuugagauacauugacauaggcaucagcaaucucugaaaguaaaaauuggagguuuaacaga

SEQ ID NO: 220 - RNA, 13302 nt, Homo_Sapiens
gaagcgccugugcucugccgagacugccgugcccauugcucgccucggucgccgccgcuuuagccgccuccgggggagcggccgccuauugucuuucuccgcggcgaaggugaagaguugucccagcucggcccgcgggggagccccgggagccgcacguguccugggucaugaaacuuaauccacagcaagcucccuuauauggugauuguguuguuacagugcugcuugcugaagaggacaaagcugaagaugauguaguguuuuacuugguauuuuuggguuccacccuccgucacuguacaaguacucggaaggucaguucugauacauuggagaccauugcuccuggucaugauuguugugaaacagugaaggugcagcucugugcuuccaaagagggccuucccguguuugugguggcugaagaagacuuucauuucguccaggaugaagcguaugaugcagcucaauuccuagcaaccagugcuggaaaucagcaggcuuugaacuuuacccguuuucuugaccagucaggacccccaucuggggaugugaauucccuugauaagaaguuggugcuggcauucaggcaccugaagcugcccacggaguggaauguauuggggacagaucagaguuugcaugaugcuggcccgcgagagacauugaugcauuuugcugugcggcugggacugcugagguugacgugguuccuguugcagaagccagguggccgcggagcucucaguauccacaaccaggaaggggcgacgccugugagcuuggccuuggagcgaggcuaucacaagcugcaccagcuucuaaccgaggagaaugcuggagaaccagacuccuggagcaguuuauccuaugaaauaccguauggagacuguucugugaggcaucaucgagaguuggacaucuauacauuaaccucugagucugauucacaucaugaacacccauuuccuggagacgguugcacuggaccaauuuuuaaacuuaugaacauccaacagcaacuaaugaaaacaaaccucaagcagauggacagucuuaugcccuuaaugaugacagcacaggauccuuccagugccccagagacagauggccaguuucuucccugugcaccggagcccacggacccucagcgacuuucuucuucugaagagacugagagcacucagugcugcccagggagcccuguugcacagacugaaagucccugugauuugucaagcauaguugaggaggagaauacagaccguuccuguaggaagaaaaauaaaggcguggaaagaaaaggggaagagguggagccagcaccuauuguggacucuggaacuguaucugaucaagacagcugccuucagagcuugccugauuguggaguaaagggcacggaaggccuuucguccuguggaaacagaaaugaagaaacuggaacaaaaucuucuggaaugcccacagaccaggagucccugagcaguggagaugcugugcuucagagagacuuggucauggagccaggcacagcccaguauuccucuggaggugaacugggaggcauuucaacaacaaaugucaguaccccagacacugcaggggaaauggaacaugggcucaugaacccagaugccacuguuuggaagaaugugcuucagggaggggaaaguacaaaggaaagauuugagaacucuaauauuggcacagcuggagccucugacgugcacgucacaaguaagccuguggauaaaaucaguguuccaaacugugccccugcugccaguucccuggaugguaacaaaccugcugagucuucacuugcauuuaguaaugaagaaaccuccacugaaaaaacagcagaaacggaaacuucacgaagucgugaggagagugcugaugcuccaguagaucagaauucuguggugauuccagcugcugcaaaagacaagauuucagauggauuagaaccuuauacucucuuagcagcaggcauaggugaggcaaugucacccucagauuuagcccuucuugggcuggaagaagauguaaugccacaccagaacucagaaacaaauucaucucaugcucaaagccaaaagggcaaauccucacccauuuguucuacaacuggagacgauaaacuuugugcagacucugcaugucaacagaacacagugacuucuaguggcgauuugguugcaaaacugugugauaacauaguuagcgaguccgaaagcaccacagcaaggcaacccagcucacaagauccacccgaugccucccacugugaagacccacaggcucauacagucaccucugacccuguaagggauacccaggaacgugcggauuuuuguccuuucaaagugguggauaacaaaggccaacgaaaagaugugaaacuagauaaaccuuuaacaaauaugcuugaggugguuucacauccacauccaguugucccuaaaauggagaaagaacuggugccagaccaggcaguaauaucagacaguacuuucucucuggcaaacaguccaggcagugaaucaguaaccaaggaugacgcacuuucuuuuguccccucccagaaagaaaagggaacagcaacuccugaacuacauacagcuacagauuauagagauggcccagauggaaauucgaaugagccugauacgcggccacuagaagacagggcaguaggccuguccacauccuccacugcugcagagcuucagcacgggauggggaauaccagucucacaggacuugguggagagcaugagggucccgccccuccagcaaucccagaagcucugaauaucaaggggaacacugacucuucccugcaaaguguggguaaggccacuuuggcuuuagauucaguuuugacugaagaaggaaaacuucuggugguuucagaaagcucugcagcucaggaacaagauaaggauaaagcggugaccuguuccucuauuaaggaaaaugcucucucuucaggaacuuugcaggaagagcagagaacaccaccuccuggacaagauacucaacaauuucaugaaaaaucaaucucagcugacugugccaaggacaaagcacuucagcuaaguaauucaccgggugcauccucugccuuucuuaaggcagaaacugaacauaacaaggaaguggccccacaagucucacugcugacucaagguggggcugcccagagccuggugccaccaggagcaagucuggccacagagucaaggcaggaagccuugggggcagagcacaacagcuccgcucuguugccaugucuguugccagaugggucugauggguccgaugcucuuaacugcagucagccuucuccucuggauguuggagugaagaacacucaaucccagggaaaaacuagugccugugaggugaguggagaugugacgguggauguuacagggguuaaugcucuacaagguauggcugagcccagaagagagaauauaucacacaacacccaagacauccugauuccaaacgucuuguugagccaagagaagaaugccguucuagguuugccaguggcucuacaggacaaagcugugacugacccacagggaguuggaaccccagagaugauaccucuugauugggagaaagggaagcuggagggagcagaccacagcuguaccaugggugacgcugaggaagcccaaauagacgaugaagcacauccuguccuacugcagccuguugccaaggagcuccccacagacauggagcucucagcccaugaugauggggccccagcuggugugagggaagucaugcgagccccgccuucaggcagggaaaggagcacucccucucuaccuugcauggucucugcccaggacgcaccucugccuaagggggcagacuugauagaggaggcugccagccguauaguggaugcugucaucgaacaagucaaggccgcuggagcacugcuuacugagggggaggccugucacaugucacuguccagcccugaguuggguccucucacuaaaggacuagagagugcuuuuacagaaaaagugaguacuuucccaccuggggagagccuaccaaugggcaguacuccugaggaagccacggggagccuugcaggauguuuugcuggaagggaggagccagagaagaucauuuuaccuguccaggggccugagccagcagcagaaaugccagacgugaaagcugaagaugaaguggauuuuagagcaaguucaauuucugaagaaguggcuguagggagcauagcugcuacacugaagaugaagcaaggcccaaugacccaggcgauaaaccgagaaaacugguguacaauagagccaugcccugaugcagcaucucuucuggcuuccaagcagagcccagaaugugagaacuuccuggauguuggacugggcagagaguguaccucaaaacaagguguacuuaaaagagaaucugggagugauucugaccucuuucacucacccagugaugacauggacagcaucaucuucccaaagccagaggaagagcauuuggccugugauaucaccggauccaguucauccaccgaugacacggcuucacuggaccgacauucuucucauggcagugaugugucucucucccagauuuuaaagccaaacaggucaagagaucggcaaagccuugauggauucuacagccaugggaugggagcugagggucgagaaagugagagugagccugcugacccaggcgacguggaggaggaggagauggacaguaucacugaagugccugcaaacugcucuguccuaaggagcuccaugcgcucucuuucucccuuccggaggcacagcugggggccugggaaaaaugcagccagcgaugcagaaaugaaccaccggaguaugagcuggugccccucuggugugcaguacucugcuggccugagugcugacuuuaauuacagaaguuucagucuagaaggcuugacaggaggagcuggugucggaaacaagccauccucaucucuagaaguaagcucugcaaaugccgaagagcucagacacccauucaguggugaggaacggguugacucuuuggugucacuuucagaagaggaucuggagucagaccagagagaacauaggauguuugaucagcagauaugucacagaucuaagcagcagggauuuaauuacuguacaucagccauuuccucuccauugacaaaauccaucucauuaaugacaaucagccauccuggauuggacaauucacggcccuuccacaguaccuuccacaauaccagugcuaaucugacugagaguauaacagaagagaacuauaauuuccugccacauagccccuccaagaaagauucugaauggaagaguggaacaaaagucagucguacauucagcuacaucaagaauaaaaugucuagcagcaagaagagcaaagaaaaggaaaaagaaaaagauaagauuaaggagaaggagaaagauucuaaagacaaggagaaagauaagaagacugucaacgggcacacuuucaguuccauuccuguugugggucccaucagcuguagccaguguaugaagcccuucaccaacaaagaugccuauacuugugcaaauugcagugcuuuuguccacaaaggcugccgagaaagucuagccuccugugcaaaggucaaaaugaagcagcccaaagggagccuucaggcacaugacacaucaucacugcccacggucauuaugagaaacaagcccucacagcccaaggagcguccucgguccgcaguccuccugguggaugaaaccgcuaccaccccaauauuugccaauagacgaucccagcagagugucucgcucuccaaaagugucuccauacagaacauuacuggaguuggcaaugaugagaacaugucaaacaccuggaaauuccugucucauucaacagacucacuaaauaaaaucagcaaggucaaugagucaacagaaucacuuacugaugagggaguagguacagacaugaaugaaggacaacuacugggagacuuugagauugaguccaaacagcuggaagcagagucuuggagucggauaauagacagcaaguuucuaaaacagcaaaagaaagauguggucaaacggcaagaaguaauauaugaguugaugcagacagaguuucaucauguccgcacucucaagaucaugagugguguguacagccaggggaugauggcggaucugcuuuuugagcagcagaugguagaaaagcuguuccccuguuuggaugagcugaucaguauccauagccaauucuuccagaggauucuggagcggaagaaggagucucugguggauaaaagugaaaagaacuuucucaucaagaggauaggggaugugcuuguaaaucaguuuucaggugagaaugcagaacguuuaaagaagacauauggcaaguuuugugggcaacauaaccagucuguaaacuacuucaaagaccuuuaugccaaggauaagcguuuucaagccuuuguaaagaagaagaugagcaguucaguuguuagaaggcuuggaauuccagagugcauauugcuuguaacucagcggauuaccaaguacccaguuuuauuccaaagaauauugcaguguaccaaagacaaugaaguggagcaggaagaucuagcacaguccuugagccuggugaaggaugugauuggagcuguagacagcaaaguggcaaguuaugaaaagaaagugcgucucaaugagauuuauacaaagacagauagcaagucaaucaugaggaugaagaguggucagauguuugccaaggaagauuugaaacggaagaagcuuguacgugaugggaguguguuucugaagaaugcagcaggaagguugaaagagguucaagcaguucuucucacugacauuuuaguuuuccuucaagaaaaagaccagaaguacaucuuugcaucauuggaccagaagucaacagugaucucuuuaaagaagcugauugugagagaaguggcacaugaggagaaagguuuauuccugaucagcauggggaugacagauccagagaugguagaaguccaugccagcuccaaagaggaacgaaacagcuggauucagaucauucaggacacaaucaacacccugaacagagaugaagaugaaggaauuccuagugagaaugaggaagaaaagaaaauguuggacaccagagcccgagaauuaaaagaacaacuucaccagaaggaccaaaaaauccuacucuuguuggaagagaaggagaugauuuuccgggacauggcugagugcagcaccccucucccagaggauugcuccccaacacauagcccuagaguucucuuccgcuccaacacagaagaggcucucaaaggaggaccuuuaaugaaaagugcaauaaaugagguggagauccuucaggguuuggugaguggaaaucugggaggcacacuugggccgacugucagcagccccauugagcaagauguggucggucccguuucccugccccggagagcagagaccuuuggaggauuugacagccaucagaugaaugcuucaaaaggaggcgagaaggaagagggagaugauggccaagaucuuaggagaacggaaucagauaguggccuaaaaaaggguggaaaugcuaaccugguauuuaugcuuaaaagaaacagugagcagguuguccagagcguuguucaucucuacgagcuccucagcgcucugcaggguguggugcugcagcaggacagcuacauugaggaccagaaacuggugcugagcgagagggcgcucacucgcagcuugucccgcccgagcucccucauugagcaggagaagcagcgcagccuggagaagcagcgccaggaccuggccaaccugcagaagcagcaggcccaguaccucgaggagaagcgcaggcgcgagcgugagugggaagcucgugagagggagcugcgggagcgggaggcccuccuggcccagcgcgaggaggaggugcagcaggggcagcaggaccuggaaaaggagcgggaggagcuccagcagaagaagggcacauaccaguaugaccuggagcgacugcgugcugcccagaaacagcuugagagggaacaggagcagcugcgccgggaggcagagcggcucagccagcggcagacagaacgggaccugugucagguuucccauccacauaccaagcugaugaggaucccaucguucuuccccaguccugaggagccccccucgccaucugcaccuuccauagccaaaucagggucauuggacucagaacuuucaguguccccaaaaaggaacagcaucucucggacacacaaagauaaggggccuuuucacauacugaguucaaccagccagacaaacaaaggaccagaagggcagagccaggccccugcguccaccucugccucuacccgccuguuuggguuaacaaagccaaaggaaaagaaggagaaaaaaaagaagaacaaaaccagccgcucucagcccggugauggucccgcgucagaaguaucagcagagggugaagagaucuucugcugacccucuuccucucugcugaggcagcugccuccugauccuggccagcccaccucuccugcuguccccgcgugcacaagucucuuacacuggacgcccacugcuccucagcguccaguccuccugggcggccccagguccuggacaauaagcaacagaugauauugagugucggguggggaaggaggcccagacucugcuucggccaugauuugugacugcccaggacucucagguugggcuggcccuacucaggauuacacugaaaguaauggccucguaaguacaggugaugguuuuggacacgucaggaauuccuaaaggcugaaagaguguauccaaguaaggucugaaccuccgaaugccuuuuauuugggggaacacaaaaccaaacagcagauguuuuggacuugaucuguguacguacauggggaccugucugcauauacacacggggaaugccagaagaaggcccagucugcaccaggcgucuggucaacuuagcacaagggcagugccuggacggacccggagcccccgcauaucagcaguucacccaguacuccucagagacugguuucccucuaaacccaucccgggcacauaccacccguguuuugcauguauuucucauuucauuuuagggaugacaaacauuugugaaaccagugagagaaggcuugauguguauaaaagacgugaugugcaccaccucgaucucgguguuucaggcacuaaagcaacaaaacaacccauaguaucucauucugucaucagauccagaagaaauauccugguuuuccagcauguuuacccacauguuuuggccauggauaaagugaagaggccuacucaccauuaucccugcagcgugacaccuuuugauugucacugaccacucagaaggggccacggccuccuggcuguguuccugagcccccgucgugccucucccagacagcagcugucuggcccuugcugggugagggcacaccacugccaggggucagccucgcacccaggccaggcagaagcugugcucugaagcuaggacagcuggcugagaaguggguucaggcgaagggugaagccauguguagcaguuccugccagugcagaucuggagaggagcuggcccggaaggcgugguugugaaagcgcccuucuuauguuaggaggccuuggcaaaauuggauuucuucaaaaauacauguaaaggucuguuguugaauuguacucugccccuggaagcagauacagauggcugccugcugcucggcuuugcuuuugcuuuucccaccguguuuucaucuuuguucacuugaggcuuuccccagcuggugugugcaggacaguucaugguaauguugcccucugaggccccguacaccagaagggaggcccuggaaaauuuugugcuuccaacguggccuucaauucuugcuuuuuugccccucggaagcauggggcuuuugagcacacuuaaaaaaagaaaaaucuguaacuuggugcuuauugaugaauugcaagcuggccuugcagauggagauauuuaucuuucaguuuauuugaaagaggucugguuuaaaauuuguagccuacauuuguuuuauuuauuguauuuguguguuuguguuuguuuuuuuuuaagggugagccaggucuagcccaacagucuaaacuauccagucaauaccgagugaaguggcagccagcacuguucacucugugucuuuugaagugccuugaaggcccagaugaaauuuuaaagggaggggguccauguccuucccucccccaccccgccucauucuuuaaucaaaggaugucuucucccuuguuugagaaugaagaaacucgccaccucugaccuaccuuugccuuuuucugucauggagaauacucacccuucagaaacagaccaaaggccaaaaccugcugauuuuucuauugaaaauauguccccuugcaaagacccuaaacaaaaaguuaaguuucuuucuuucaccuauuuguacaacuccaaguuacagcugaaucugucgugacuuuccugagaucuacccggggcuuggcugucuguucugggcacuggcuccgaguuccccuccugggauuugcaggagggcaguacugaaccugcauucuucuccuuguaaauguaggccgggugccccuguucuccggguuuggaacaauacgagguuggugcugaugggauuuacuugcguacgugcucuucacaaaaacaccguggaugcugaaguuagagcacgucgccacagagcuugacaucaauguuagagggucucuuacuccccgcccagcugugauguuucaucugcuuugguuguuuugguggucuuuuuuaaaaauagagauuucacaucugcccagaccccacucaaaacgauuuggucagguucugguuggacaaguuuaaaaucaaaguagugcccggaauucccucaaaccacccaacuucauccaggaauacagucugcagugcagcaacagaaccgcuuaccaagaacugugcuuacauaccuuugucaucucucuuccccccuuggaaguuguccucagggggauuuguuccuguccuggggauuuaccugggaugguggcugccugugcuuuugcucauggccuugacagugcucuaguugcuggaucuaauggccugucuugguuucuaucacaugagaagggguuguuuuuuuggggugacucggacugaauuccccauacuguuuccacgccgggacaccauguucuccaucaagcuaaagaaaucacgugccugaaacugugcuuaaguuuugggggaaagauggaguuccuauccagagcccccagauuuccagaaucgagugagcuuccuggaaggagacugcgucuucucucaauuccagucaucucagucguugucguuaggugacaugugcacuuuaaaugcucucaucgguuggcuucauuuucaagacaaucaaauguauugacuguguuuucuucuuagaaaauggagaggguuaaaaacaugcaaacugccacuuucaaccuuugccaguauucccucuacccccgugagagcuaucuggggggaagaauccuuaccaagguuuuuuuggaaagguacgaaucuuaacuuuuuuccccuucugugucucaggguaauacuauucagagucgccccuuugcucauuuucucccguauuuguuaccuuccugaggccucaguauuagucgugagcacaaaguuuugagaccuuuggcguuguuucuugaugugggaggggagguguuagugcaugcaaggguugaacuagauagacccugccuuaguagagggugggacuauaaccuuagaggccagaacuugauccagaaguugcuguccacagaagugcuuucuauuucaucauuuuuguuucuagggcucuuuuucuguagccaggucuucccaaggauuuuaguauuugcauuggaguugagguuuacucuaaugaugguggcccagcugugcccagaggacagccaggcaggcccugggagggaguuuagaaagacaguccuggugaaugggcuucaaguggucacaaagaggguggcugugaggugaccccagacacugcagaacgaugugcacccucugcguuuuggauguccuuggaaugugggagccuagaaauaacccuguggauggaauuggggcagcggcugcuggagaucugugugccuugccuuccuucagcaggaccgucuaggugcgcagccaccuauggaugcgucccagccagccccgucgcucucguccauccucagagacaaagaagagggcagggaguuugggcuugguuuugaacuuuccuuucaauguagcaaagcauuccuaguuaaccagagccuuggaaucuacugccugcuggccaggcuuuaaaaugaaaaguguuuuaaugcugccauaaaagggaggcgggggggaggaagggaaaauaaaggcaucuuuccaaguacucaucuaauuuaauugucaaaagauugauaggccaugaauuacuucuccaucucacuaaggguuaaaggcgugcaaccccccacuggcuguguccccugccaccgaagugagugaccugcccuacaaccaggugggaccaccugugcugcaguccggaggggcuucugcaggaagcacucaccccccacaccuuccccggccugagcuuccccuaccuuucgucaccaccugagggcaugagcacaggccauggggcgugccuggugagucugccugugguucaggcuuagccuguggucuccugugugcugcugcccgcaugggaugcgcaggggaggcguggggauccgcaggagggugguugggauacaccggauaccucugcucucauugcuuguuugcaaaugcucuauggacauuugugugcuaaauccuauuaaauaaaaaagacggguuaaaacccagaugcuguauauucauuuguaauuauguauaaagugaagcaguuuuaaacuguaaagauuuuuuucaguguguuuucucgaauuuugccacaacauacuggcuucguauuuuauuuaucuuucuuucuaguuaccagcuucagacccuuguaaagucucccucagcccuuucaaaaaauaauaaauuuccugugaaguu

SEQ ID NO: 221 - RNA, 13290 nt, Homo_Sapiens
gaagcgccugugcucugccgagacugccgugcccauugcucgccucggucgccgccgcuuuagccgccuccgggggagcggccgccuauugucuuucuccgcggcgaaggugaagaguugucccagcucggcccgcgggggagccccgggagccgcacguguccugggucaugaaacuuaauccacagcaagcucccuuauauggugauuguguuguuacagugcugcuugcugaagaggacaaagcugaagaugauguaguguuuuacuugguauuuuuggguuccacccuccgucacuguacaaguacucggaaggucaguucugauacauuggagaccauugcuccuggucaugauuguugugaaacagugaaggugcagcucugugcuuccaaagagggccuucccguguuugugguggcugaagaagacuuucauuucguccaggaugaagcguaugaugcagcucaauuccuagcaaccagugcuggaaaucagcaggcuuugaacuuuacccguuuucuugaccagucaggacccccaucuggggaugugaauucccuugauaagaaguuggugcuggcauucaggcaccugaagcugcccacggaguggaauguauuggggacagaucagaguuugcaugaugcuggcccgcgagagacauugaugcauuuugcugugcggcugggacugcugagguugacgugguuccuguugcagaagccagguggccgcggagcucucaguauccacaaccaggaaggggcgacgccugugagcuuggccuuggagcgaggcuaucacaagcugcaccagcuucuaaccgaggagaaugcuggagaaccagacuccuggagcaguuuauccuaugaaauaccguauggagacuguucugugaggcaucaucgagaguuggacaucuauacauuaaccucugagucugauucacaucaugaacacccauuuccuggagacgguugcacuggaccaauuuuuaaacuuaugaacauccaacagcaacuaaugaaaacaaaccucaagcagauggacagucuuaugcccuuaaugaugacagcacaggauccuuccagugccccagagacagauggccaguuucuucccugugcaccggagcccacggacccucagcgacuuucuucuucugaagagacugagagcacucagugcugcccagggagcccuguugcacagacugaaagucccugugauuugucaagcauaguugaggaggagaauacagaccguuccuguaggaagaaaaauaaaggcguggaaagaaaaggggaagagguggagccagcaccuauuguggacucuggaacuguaucugaucaagacagcugccuucagagcuugccugauuguggaguaaagggcacggaaggccuuucguccuguggaaacagaaaugaagaaacuggaacaaaaucuucuggaaugcccacagaccaggagucccugagcaguggagaugcugugcuucagagagacuuggucauggagccaggcacagcccaguauuccucuggaggugaacugggaggcauuucaacaacaaaugucaguaccccagacacugcaggggaaauggaacaugggcucaugaacccagaugccacuguuuggaagaaugugcuucagggaggggaaaguacaaaggaaagauuugagaacucuaauauuggcacagcuggagccucugacgugcacgucacaaguaagccuguggauaaaaucaguguuccaaacugugccccugcugccaguucccuggaugguaacaaaccugcugagucuucacuugcauuuaguaaugaagaaaccuccacugaaaaaacagcagaaacggaaacuucacgaagucgugaggagagugcugaugcuccaguagaucagaauucuguggugauuccagcugcugcaaaagacaagauuucagauggauuagaaccuuauacucucuuagcagcaggcauaggugaggcaaugucacccucagauuuagcccuucuugggcuggaagaagauguaaugccacaccagaacucagaaacaaauucaucucaugcucaaagccaaaagggcaaauccucacccauuuguucuacaacuggagacgauaaacuuugugcagacucugcaugucaacagaacacagugacuucuaguggcgauuugguugcaaaacugugugauaacauaguuagcgaguccgaaagcaccacagcaaggcaacccagcucacaagauccacccgaugccucccacugugaagacccacaggcucauacagucaccucugacccuguaagggauacccaggaacgugcggauuuuuguccuuucaaagugguggauaacaaaggccaacgaaaagaugugaaacuagauaaaccuuuaacaaauaugcuugaggugguuucacauccacauccaguugucccuaaaauggagaaagaacuggugccagaccaggcaguaauaucagacaguacuuucucucuggcaaacaguccaggcagugaaucaguaaccaaggaugacgcacuuucuuuuguccccucccagaaagaaaagggaacagcaacuccugaacuacauacagcuacagauuauagagauggcccagauggaaauucgaaugagccugauacgcggccacuagaagacagggcaguaggccuguccacauccuccacugcugcagagcuucagcacgggauggggaauaccagucucacaggacuugguggagagcaugagggucccgccccuccagcaaucccagaagcucugaauaucaaggggaacacugacucuucccugcaaaguguggguaaggccacuuuggcuuuagauucaguuuugacugaagaaggaaaacuucuggugguuucagaaagcucugcagcucaggaacaagauaaggauaaagcggugaccuguuccucuauuaaggaaaaugcucucucuucaggaacuuugcaggaagagcagagaacaccaccuccuggacaagauacucaacaauuucaugaaaaaucaaucucagcugacugugccaaggacaaagcacuucagcuaaguaauucaccgggugcauccucugccuuucuuaaggcagaaacugaacauaacaaggaaguggccccacaagucucacugcugacucaagguggggcugcccagagccuggugccaccaggagcaagucuggccacagagucaaggcaggaagccuugggggcagagcacaacagcuccgcucuguugccaugucuguugccagaugggucugauggguccgaugcucuuaacugcagucagccuucuccucuggauguuggagugaagaacacucaaucccagggaaaaacuagugccugugaggugaguggagaugugacgguggauguuacagggguuaaugcucuacaagguauggcugagcccagaagagagaauauaucacacaacacccaagacauccugauuccaaacgucuuguugagccaagagaagaaugccguucuagguuugccaguggcucuacaggacaaagcugugacugacccacagggaguuggaaccccagagaugauaccucuugauugggagaaagggaagcuggagggagcagaccacagcuguaccaugggugacgcugaggaagcccaaauagacgaugaagcacauccuguccuacugcagccuguugccaaggagcuccccacagacauggagcucucagcccaugaugauggggccccagcuggugugagggaagucaugcgagccccgccuucaggcagggaaaggagcacucccucucuaccuugcauggucucugcccaggacgcaccucugccuaagggggcagacuugauagaggaggcugccagccguauaguggaugcugucaucgaacaagucaaggccgcuggagcacugcuuacugagggggaggccugucacaugucacuguccagcccugaguuggguccucucacuaaaggacuagagagugcuuuuacagaaaaagugaguacuuucccaccuggggagagccuaccaaugggcaguacuccugaggaagccacggggagccuugcaggauguuuugcuggaagggaggagccagagaagaucauuuuaccuguccaggggccugagccagcagcagaaaugccagacgugaaagcugaagaugaaguggauuuuagagcaaguucaauuucugaagaaguggcuguagggagcauagcugcuacacugaagaugaagcaaggcccaaugacccaggcgauaaaccgagaaaacugguguacaauagagccaugcccugaugcagcaucucuucuggcuuccaagcagagcccagaaugugagaacuuccuggauguuggacugggcagagaguguaccucaaaacaagguguacuuaaaagagaaucugggagugauucugaccucuuucacucacccagugaugacauggacagcaucaucuucccaaagccagaggaagagcauuuggccugugauaucaccggauccaguucauccaccgaugacacggcuucacuggaccgacauucuucucauggcagugaugugucucucucccagauuuuaaagccaaacaggucaagagaucggcaaagccuugauggauucuacagccaugggaugggagcugagggucgagaaagugagagugagccugcugacccaggcgacguggaggaggaggagauggacaguaucacugaagugccugcaaacugcucuguccuaaggagcuccaugcgcucucuuucucccuuccggaggcacagcugggggccugggaaaaaugcagccagcgaugcagaaaugaaccaccggaguucaaugcgaguucuuggggauguugucaggagaccucccauucauaggagaaguuucagucuagaaggcuugacaggaggagcuggugucggaaacaagccauccucaucucuagaaguaagcucugcaaaugccgaagagcucagacacccauucaguggugaggaacggguugacucuuuggugucacuuucagaagaggaucuggagucagaccagagagaacauaggauguuugaucagcagauaugucacagaucuaagcagcagggauuuaauuacuguacaucagccauuuccucuccauugacaaaauccaucucauuaaugacaaucagccauccuggauuggacaauucacggcccuuccacaguaccuuccacaauaccagugcuaaucugacugagaguauaacagaagagaacuauaauuuccugccacauagccccuccaagaaagauucugaauggaagaguggaacaaaagucagucguacauucagcuacaucaagaauaaaaugucuagcagcaagaagagcaaagaaaaggaaaaagaaaaagauaagauuaaggagaaggagaaagauucuaaagacaaggagaaagauaagaagacugucaacgggcacacuuucaguuccauuccuguugugggucccaucagcuguagccaguguaugaagcccuucaccaacaaagaugccuauacuugugcaaauugcagugcuuuuguccacaaaggcugccgagaaagucuagccuccugugcaaaggucaaaaugaagcagcccaaagggagccuucaggcacaugacacaucaucacugcccacggucauuaugagaaacaagcccucacagcccaaggagcguccucgguccgcaguccuccugguggaugaaaccgcuaccaccccaauauuugccaauagacgaucccagcagagugucucgcucuccaaaagugucuccauacagaacauuacuggaguuggcaaugaugagaacaugucaaacaccuggaaauuccugucucauucaacagacucacuaaauaaaaucagcaaggucaaugagucaacagaaucacuuacugaugagggaguagguacagacaugaaugaaggacaacuacugggagacuuugagauugaguccaaacagcuggaagcagagucuuggagucggauaauagacagcaaguuucuaaaacagcaaaagaaagauguggucaaacggcaagaaguaauauaugaguugaugcagacagaguuucaucauguccgcacucucaagaucaugagugguguguacagccaggggaugauggcggaucugcuuuuugagcagcagaugguagaaaagcuguuccccuguuuggaugagcugaucaguauccauagccaauucuuccagaggauucuggagcggaagaaggagucucugguggauaaaagugaaaagaacuuucucaucaagaggauaggggaugugcuuguaaaucaguuuucaggugagaaugcagaacguuuaaagaagacauauggcaaguuuugugggcaacauaaccagucuguaaacuacuucaaagaccuuuaugccaaggauaagcguuuucaagccuuuguaaagaagaagaugagcaguucaguuguuagaaggcuuggaauuccagagugcauauugcuuguaacucagcggauuaccaaguacccaguuuuauuccaaagaauauugcaguguaccaaagacaaugaaguggagcaggaagaucuagcacaguccuugagccuggugaaggaugugauuggagcuguagacagcaaaguggcaaguuaugaaaagaaagugcgucucaaugagauuuauacaaagacagauagcaagucaaucaugaggaugaagaguggucagauguuugccaaggaagauuugaaacggaagaagcuuguacgugaugggaguguguuucugaagaaugcagcaggaagguugaaagagguucaagcaguucuucucacugacauuuuaguuuuccuucaagaaaaagaccagaaguacaucuuugcaucauuggaccagaagucaacagugaucucuuuaaagaagcugauugugagagaaguggcacaugaggagaaagguuuauuccugaucagcauggggaugacagauccagagaugguagaaguccaugccagcuccaaagaggaacgaaacagcuggauucagaucauucaggacacaaucaacacccugaacagagaugaagaugaaggaauuccuagugagaaugaggaagaaaagaaaauguuggacaccagagcccgagaauuaaaagaacaacuucaccagaaggaccaaaaaauccuacucuuguuggaagagaaggagaugauuuuccgggacauggcugagugcagcaccccucucccagaggauugcuccccaacacauagcccuagaguucucuuccgcuccaacacagaagaggcucucaaaggaggaccuuuaaugaaaagugcaauaaaugagguggagauccuucaggguuuggugaguggaaaucugggaggcacacuugggccgacugucagcagccccauugagcaagauguggucggucccguuucccugccccggagagcagagaccuuuggaggauuugacagccaucagaugaaugcuucaaaaggaggcgagaaggaagagggagaugauggccaagaucuuaggagaacggaaucagauaguggccuaaaaaaggguggaaaugcuaaccugguauuuaugcuuaaaagaaacagugagcagguuguccagagcguuguucaucucuacgagcuccucagcgcucugcaggguguggugcugcagcaggacagcuacauugaggaccagaaacuggugcugagcgagagggcgcucacucgcagcuugucccgcccgagcucccucauugagcaggagaagcagcgcagccuggagaagcagcgccaggaccuggccaaccugcagaagcagcaggcccaguaccucgaggagaagcgcaggcgcgagcgugagugggaagcucgugagagggagcugcgggagcgggaggcccuccuggcccagcgcgaggaggaggugcagcaggggcagcaggaccuggaaaaggagcgggaggagcuccagcagaagaagggcacauaccaguaugaccuggagcgacugcgugcugcccagaaacagcuugagagggaacaggagcagcugcgccgggaggcagagcggcucagccagcggcagacagaacgggaccugugucagguuucccauccacauaccaagcugaugaggaucccaucguucuuccccaguccugaggagccccccucgccaucugcaccuuccauagccaaaucagggucauuggacucagaacuuucaguguccccaaaaaggaacagcaucucucggacacacaaagauaaggggccuuuucacauacugaguucaaccagccagacaaacaaaggaccagaagggcagagccaggccccugcguccaccucugccucuacccgccuguuuggguuaacaaagccaaaggaaaagaaggagaaaaaaaagaagaacaaaaccagccgcucucagcccggugauggucccgcgucagaaguaucagcagagggugaagagaucuucugcugacccucuuccucucugcugaggcagcugccuccugauccuggccagcccaccucuccugcuguccccgcgugcacaagucucuuacacuggacgcccacugcuccucagcguccaguccuccugggcggccccagguccuggacaauaagcaacagaugauauugagugucggguggggaaggaggcccagacucugcuucggccaugauuugugacugcccaggacucucagguugggcuggcccuacucaggauuacacugaaaguaauggccucguaaguacaggugaugguuuuggacacgucaggaauuccuaaaggcugaaagaguguauccaaguaaggucugaaccuccgaaugccuuuuauuugggggaacacaaaaccaaacagcagauguuuuggacuugaucuguguacguacauggggaccugucugcauauacacacggggaaugccagaagaaggcccagucugcaccaggcgucuggucaacuuagcacaagggcagugccuggacggacccggagcccccgcauaucagcaguucacccaguacuccucagagacugguuucccucuaaacccaucccgggcacauaccacccguguuuugcauguauuucucauuucauuuuagggaugacaaacauuugugaaaccagugagagaaggcuugauguguauaaaagacgugaugugcaccaccucgaucucgguguuucaggcacuaaagcaacaaaacaacccauaguaucucauucugucaucagauccagaagaaauauccugguuuuccagcauguuuacccacauguuuuggccauggauaaagugaagaggccuacucaccauuaucccugcagcgugacaccuuuugauugucacugaccacucagaaggggccacggccuccuggcuguguuccugagcccccgucgugccucucccagacagcagcugucuggcccuugcugggugagggcacaccacugccaggggucagccucgcacccaggccaggcagaagcugugcucugaagcuaggacagcuggcugagaaguggguucaggcgaagggugaagccauguguagcaguuccugccagugcagaucuggagaggagcuggcccggaaggcgugguugugaaagcgcccuucuuauguuaggaggccuuggcaaaauuggauuucuucaaaaauacauguaaaggucuguuguugaauuguacucugccccuggaagcagauacagauggcugccugcugcucggcuuugcuuuugcuuuucccaccguguuuucaucuuuguucacuugaggcuuuccccagcuggugugugcaggacaguucaugguaauguugcccucugaggccccguacaccagaagggaggcccuggaaaauuuugugcuuccaacguggccuucaauucuugcuuuuuugccccucggaagcauggggcuuuugagcacacuuaaaaaaagaaaaaucuguaacuuggugcuuauugaugaauugcaagcuggccuugcagauggagauauuuaucuuucaguuuauuugaaagaggucugguuuaaaauuuguagccuacauuuguuuuauuuauuguauuuguguguuuguguuuguuuuuuuuuaagggugagccaggucuagcccaacagucuaaacuauccagucaauaccgagugaaguggcagccagcacuguucacucugugucuuuugaagugccuugaaggcccagaugaaauuuuaaagggaggggguccauguccuucccucccccaccccgccucauucuuuaaucaaaggaugucuucucccuuguuugagaaugaagaaacucgccaccucugaccuaccuuugccuuuuucugucauggagaauacucacccuucagaaacagaccaaaggccaaaaccugcugauuuuucuauugaaaauauguccccuugcaaagacccuaaacaaaaaguuaaguuucuuucuuucaccuauuuguacaacuccaaguuacagcugaaucugucgugacuuuccugagaucuacccggggcuuggcugucuguucugggcacuggcuccgaguuccccuccugggauuugcaggagggcaguacugaaccugcauucuucuccuuguaaauguaggccgggugccccuguucuccggguuuggaacaauacgagguuggugcugaugggauuuacuugcguacgugcucuucacaaaaacaccguggaugcugaaguuagagcacgucgccacagagcuugacaucaauguuagagggucucuuacuccccgcccagcugugauguuucaucugcuuugguuguuuugguggucuuuuuuaaaaauagagauuucacaucugcccagaccccacucaaaacgauuuggucagguucugguuggacaaguuuaaaaucaaaguagugcccggaauucccucaaaccacccaacuucauccaggaauacagucugcagugcagcaacagaaccgcuuaccaagaacugugcuuacauaccuuugucaucucucuuccccccuuggaaguuguccucagggggauuuguuccuguccuggggauuuaccugggaugguggcugccugugcuuuugcucauggccuugacagugcucuaguugcuggaucuaauggccugucuugguuucuaucacaugagaagggguuguuuuuuuggggugacucggacugaauuccccauacuguuuccacgccgggacaccauguucuccaucaagcuaaagaaaucacgugccugaaacugugcuuaaguuuugggggaaagauggaguuccuauccagagcccccagauuuccagaaucgagugagcuuccuggaaggagacugcgucuucucucaauuccagucaucucagucguugucguuaggugacaugugcacuuuaaaugcucucaucgguuggcuucauuuucaagacaaucaaauguauugacuguguuuucuucuuagaaaauggagaggguuaaaaacaugcaaacugccacuuucaaccuuugccaguauucccucuacccccgugagagcuaucuggggggaagaauccuuaccaagguuuuuuuggaaagguacgaaucuuaacuuuuuuccccuucugugucucaggguaauacuauucagagucgccccuuugcucauuuucucccguauuuguuaccuuccugaggccucaguauuagucgugagcacaaaguuuugagaccuuuggcguuguuucuugaugugggaggggagguguuagugcaugcaaggguugaacuagauagacccugccuuaguagagggugggacuauaaccuuagaggccagaacuugauccagaaguugcuguccacagaagugcuuucuauuucaucauuuuuguuucuagggcucuuuuucuguagccaggucuucccaaggauuuuaguauuugcauuggaguugagguuuacucuaaugaugguggcccagcugugcccagaggacagccaggcaggcccugggagggaguuuagaaagacaguccuggugaaugggcuucaaguggucacaaagaggguggcugugaggugaccccagacacugcagaacgaugugcacccucugcguuuuggauguccuuggaaugugggagccuagaaauaacccuguggauggaauuggggcagcggcugcuggagaucugugugccuugccuuccuucagcaggaccgucuaggugcgcagccaccuauggaugcgucccagccagccccgucgcucucguccauccucagagacaaagaagagggcagggaguuugggcuugguuuugaacuuuccuuucaauguagcaaagcauuccuaguuaaccagagccuuggaaucuacugccugcuggccaggcuuuaaaaugaaaaguguuuuaaugcugccauaaaagggaggcgggggggaggaagggaaaauaaaggcaucuuuccaaguacucaucuaauuuaauugucaaaagauugauaggccaugaauuacuucuccaucucacuaaggguuaaaggcgugcaaccccccacuggcuguguccccugccaccgaagugagugaccugcccuacaaccaggugggaccaccugugcugcaguccggaggggcuucugcaggaagcacucaccccccacaccuuccccggccugagcuuccccuaccuuucgucaccaccugagggcaugagcacaggccauggggcgugccuggugagucugccugugguucaggcuuagccuguggucuccugugugcugcugcccgcaugggaugcgcaggggaggcguggggauccgcaggagggugguugggauacaccggauaccucugcucucauugcuuguuugcaaaugcucuauggacauuugugugcuaaauccuauuaaauaaaaaagacggguuaaaacccagaugcuguauauucauuuguaauuauguauaaagugaagcaguuuuaaacuguaaagauuuuuuucaguguguuuucucgaauuuugccacaacauacuggcuucguauuuuauuuaucuuucuuucuaguuaccagcuucagacccuuguaaagucucccucagcccuuucaaaaaauaauaaauuuccugugaaguu

SEQ ID NO: 222 - RNA, 8081 nt, Homo_Sapiens
gucuaaaacucucuuuucucuuggcucuucuuauucgagugaugaggaggaggaguugcauaauucacggcccuuccacaguaccuuccacaauaccagugcuaaucugacugagaguauaacagaagagaacuauaauuuccugccacauagccccuccaagaaagauucugaauggaagaguggaacaaaagucagucguacauucagcuacaucaagaauaaaaugucuagcagcaagaagagcaaagaaaaggaaaaagaaaaagauaagauuaaggagaaggagaaagauucuaaagacaaggagaaagauaagaagacugucaacgggcacacuuucaguuccauuccuguugugggucccaucagcuguagccaguguaugaagcccuucaccaacaaagaugccuauacuugugcaaauugcagugcuuuuguccacaaaggcugccgagaaagucuagccuccugugcaaaggucaaaaugaagcagcccaaagggagccuucaggcacaugacacaucaucacugcccacggucauuaugagaaacaagcccucacagcccaaggagcguccucgguccgcaguccuccugguggaugaaaccgcuaccaccccaauauuugccaauagacgaucccagcagagugucucgcucuccaaaagugucuccauacagaacauuacuggaguuggcaaugaugagaacaugucaaacaccuggaaauuccugucucauucaacagacucacuaaauaaaaucagcaaggucaaugagucaacagaaucacuuacugaugagggaguagguacagacaugaaugaaggacaacuacugggagacuuugagauugaguccaaacagcuggaagcagagucuuggagucggauaauagacagcaaguuucuaaaacagcaaaagaaagauguggucaaacggcaagaaguaauauaugaguugaugcagacagaguuucaucauguccgcacucucaagaucaugagugguguguacagccaggggaugauggcggaucugcuuuuugagcagcagaugguagaaaagcuguuccccuguuuggaugagcugaucaguauccauagccaauucuuccagaggauucuggagcggaagaaggagucucugguggauaaaagugaaaagaacuuucucaucaagaggauaggggaugugcuuguaaaucaguuuucaggugagaaugcagaacguuuaaagaagacauauggcaaguuuugugggcaacauaaccagucuguaaacuacuucaaagaccuuuaugccaaggauaagcguuuucaagccuuuguaaagaagaagaugagcaguucaguuguuagaaggcuuggaauuccagagugcauauugcuuguaacucagcggauuaccaaguacccaguuuuauuccaaagaauauugcaguguaccaaagacaaugaaguggagcaggaagaucuagcacaguccuugagccuggugaaggaugugauuggagcuguagacagcaaaguggcaaguuaugaaaagaaagugcgucucaaugagauuuauacaaagacagauagcaagucaaucaugaggaugaagaguggucagauguuugccaaggaagauuugaaacggaagaagcuuguacgugaugggaguguguuucugaagaaugcagcaggaagguugaaagagguucaagcaguucuucucacugacauuuuaguuuuccuucaagaaaaagaccagaaguacaucuuugcaucauuggaccagaagucaacagugaucucuuuaaagaagcugauugugagagaaguggcacaugaggagaaagguuuauuccugaucagcauggggaugacagauccagagaugguagaaguccaugccagcuccaaagaggaacgaaacagcuggauucagaucauucaggacacaaucaacacccugaacagagaugaagaugaaggaauuccuagugagaaugaggaagaaaagaaaauguuggacaccagagcccgagaauuaaaagaacaacuucaccagaaggaccaaaaaauccuacucuuguuggaagagaaggagaugauuuuccgggacauggcugagugcagcaccccucucccagaggauugcuccccaacacauagcccuagaguucucuuccgcuccaacacagaagaggcucucaaaggaggaccuuuaaugaaaagugcaauaaaugagguggagauccuucaggguuuggugaguggaaaucugggaggcacacuugggccgacugucagcagccccauugagcaagauguggucggucccguuucccugccccggagagcagagaccuuuggaggauuugacagccaucagaugaaugcuucaaaaggaggcgagaaggaagagggagaugauggccaagaucuuaggagaacggaaucagauaguggccuaaaaaaggguggaaaugcuaaccugguauuuaugcuuaaaagaaacagugagcagguuguccagagcguuguucaucucuacgagcuccucagcgcucugcaggguguggugcugcagcaggacagcuacauugaggaccagaaacuggugcugagcgagagggcgcucacucgcagcuugucccgcccgagcucccucauugagcaggagaagcagcgcagccuggagaagcagcgccaggaccuggccaaccugcagaagcagcaggcccaguaccucgaggagaagcgcaggcgcgagcgugagugggaagcucgugagagggagcugcgggagcgggaggcccuccuggcccagcgcgaggaggaggugcagcaggggcagcaggaccuggaaaaggagcgggaggagcuccagcagaagaagggcacauaccaguaugaccuggagcgacugcgugcugcccagaaacagcuugagagggaacaggagcagcugcgccgggaggcagagcggcucagccagcggcagacagaacgggaccugugucagguuucccauccacauaccaagcugaugaggaucccaucguucuuccccaguccugaggagccccccucgccaucugcaccuuccauagccaaaucagggucauuggacucagaacuuucaguguccccaaaaaggaacagcaucucucggacacacaaagauaaggggccuuuucacauacugaguucaaccagccagacaaacaaaggaccagaagggcagagccaggccccugcguccaccucugccucuacccgccuguuuggguuaacaaagccaaaggaaaagaaggagaaaaaaaagaagaacaaaaccagccgcucucagcccggugauggucccgcgucagaaguaucagcagagggugaagagaucuucugcugacccucuuccucucugcugaggcagcugccuccugauccuggccagcccaccucuccugcuguccccgcgugcacaagucucuuacacuggacgcccacugcuccucagcguccaguccuccugggcggccccagguccuggacaauaagcaacagaugauauugagugucggguggggaaggaggcccagacucugcuucggccaugauuugugacugcccaggacucucagguugggcuggcccuacucaggauuacacugaaaguaauggccucguaaguacaggugaugguuuuggacacgucaggaauuccuaaaggcugaaagaguguauccaaguaaggucugaaccuccgaaugccuuuuauuugggggaacacaaaaccaaacagcagauguuuuggacuugaucuguguacguacauggggaccugucugcauauacacacggggaaugccagaagaaggcccagucugcaccaggcgucuggucaacuuagcacaagggcagugccuggacggacccggagcccccgcauaucagcaguucacccaguacuccucagagacugguuucccucuaaacccaucccgggcacauaccacccguguuuugcauguauuucucauuucauuuuagggaugacaaacauuugugaaaccagugagagaaggcuugauguguauaaaagacgugaugugcaccaccucgaucucgguguuucaggcacuaaagcaacaaaacaacccauaguaucucauucugucaucagauccagaagaaauauccugguuuuccagcauguuuacccacauguuuuggccauggauaaagugaagaggccuacucaccauuaucccugcagcgugacaccuuuugauugucacugaccacucagaaggggccacggccuccuggcuguguuccugagcccccgucgugccucucccagacagcagcugucuggcccuugcugggugagggcacaccacugccaggggucagccucgcacccaggccaggcagaagcugugcucugaagcuaggacagcuggcugagaaguggguucaggcgaagggugaagccauguguagcaguuccugccagugcagaucuggagaggagcuggcccggaaggcgugguugugaaagcgcccuucuuauguuaggaggccuuggcaaaauuggauuucuucaaaaauacauguaaaggucuguuguugaauuguacucugccccuggaagcagauacagauggcugccugcugcucggcuuugcuuuugcuuuucccaccguguuuucaucuuuguucacuugaggcuuuccccagcuggugugugcaggacaguucaugguaauguugcccucugaggccccguacaccagaagggaggcccuggaaaauuuugugcuuccaacguggccuucaauucuugcuuuuuugccccucggaagcauggggcuuuugagcacacuuaaaaaaagaaaaaucuguaacuuggugcuuauugaugaauugcaagcuggccuugcagauggagauauuuaucuuucaguuuauuugaaagaggucugguuuaaaauuuguagccuacauuuguuuuauuuauuguauuuguguguuuguguuuguuuuuuuuuaagggugagccaggucuagcccaacagucuaaacuauccagucaauaccgagugaaguggcagccagcacuguucacucugugucuuuugaagugccuugaaggcccagaugaaauuuuaaagggaggggguccauguccuucccucccccaccccgccucauucuuuaaucaaaggaugucuucucccuuguuugagaaugaagaaacucgccaccucugaccuaccuuugccuuuuucugucauggagaauacucacccuucagaaacagaccaaaggccaaaaccugcugauuuuucuauugaaaauauguccccuugcaaagacccuaaacaaaaaguuaaguuucuuucuuucaccuauuuguacaacuccaaguuacagcugaaucugucgugacuuuccugagaucuacccggggcuuggcugucuguucugggcacuggcuccgaguuccccuccugggauuugcaggagggcaguacugaaccugcauucuucuccuuguaaauguaggccgggugccccuguucuccggguuuggaacaauacgagguuggugcugaugggauuuacuugcguacgugcucuucacaaaaacaccguggaugcugaaguuagagcacgucgccacagagcuugacaucaauguuagagggucucuuacuccccgcccagcugugauguuucaucugcuuugguuguuuugguggucuuuuuuaaaaauagagauuucacaucugcccagaccccacucaaaacgauuuggucagguucugguuggacaaguuuaaaaucaaaguagugcccggaauucccucaaaccacccaacuucauccaggaauacagucugcagugcagcaacagaaccgcuuaccaagaacugugcuuacauaccuuugucaucucucuuccccccuuggaaguuguccucagggggauuuguuccuguccuggggauuuaccugggaugguggcugccugugcuuuugcucauggccuugacagugcucuaguugcuggaucuaauggccugucuugguuucuaucacaugagaagggguuguuuuuuuggggugacucggacugaauuccccauacuguuuccacgccgggacaccauguucuccaucaagcuaaagaaaucacgugccugaaacugugcuuaaguuuugggggaaagauggaguuccuauccagagcccccagauuuccagaaucgagugagcuuccuggaaggagacugcgucuucucucaauuccagucaucucagucguugucguuaggugacaugugcacuuuaaaugcucucaucgguuggcuucauuuucaagacaaucaaauguauugacuguguuuucuucuuagaaaauggagaggguuaaaaacaugcaaacugccacuuucaaccuuugccaguauucccucuacccccgugagagcuaucuggggggaagaauccuuaccaagguuuuuuuggaaagguacgaaucuuaacuuuuuuccccuucugugucucaggguaauacuauucagagucgccccuuugcucauuuucucccguauuuguuaccuuccugaggccucaguauuagucgugagcacaaaguuuugagaccuuuggcguuguuucuugaugugggaggggagguguuagugcaugcaaggguugaacuagauagacccugccuuaguagagggugggacuauaaccuuagaggccagaacuugauccagaaguugcuguccacagaagugcuuucuauuucaucauuuuuguuucuagggcucuuuuucuguagccaggucuucccaaggauuuuaguauuugcauuggaguugagguuuacucuaaugaugguggcccagcugugcccagaggacagccaggcaggcccugggagggaguuuagaaagacaguccuggugaaugggcuucaaguggucacaaagaggguggcugugaggugaccccagacacugcagaacgaugugcacccucugcguuuuggauguccuuggaaugugggagccuagaaauaacccuguggauggaauuggggcagcggcugcuggagaucugugugccuugccuuccuucagcaggaccgucuaggugcgcagccaccuauggaugcgucccagccagccccgucgcucucguccauccucagagacaaagaagagggcagggaguuugggcuugguuuugaacuuuccuuucaauguagcaaagcauuccuaguuaaccagagccuuggaaucuacugccugcuggccaggcuuuaaaaugaaaaguguuuuaaugcugccauaaaagggaggcgggggggaggaagggaaaauaaaggcaucuuuccaaguacucaucuaauuuaauugucaaaagauugauaggccaugaauuacuucuccaucucacuaaggguuaaaggcgugcaaccccccacuggcuguguccccugccaccgaagugagugaccugcccuacaaccaggugggaccaccugugcugcaguccggaggggcuucugcaggaagcacucaccccccacaccuuccccggccugagcuuccccuaccuuucgucaccaccugagggcaugagcacaggccauggggcgugccuggugagucugccugugguucaggcuuagccuguggucuccugugugcugcugcccgcaugggaugcgcaggggaggcguggggauccgcaggagggugguugggauacaccggauaccucugcucucauugcuuguuugcaaaugcucuauggacauuugugugcuaaauccuauuaaauaaaaaagacggguuaaaacccagaugcuguauauucauuuguaauuauguauaaagugaagcaguuuuaaacuguaaagauuuuuuucaguguguuuucucgaauuuugccacaacauacuggcuucguauuuuauuuaucuuucuuucuaguuaccagcuucagacccuuguaaagucucccucagcccuuucaaaaaauaauaaauuuccugugaaguu

SEQ ID NO: 223 - RNA, 5259 nt, Homo_Sapiens
acgcgagcucguggcucgggcguaugggggcuccaacgggagcggcugcgccgcccggccgggucaacgucgugcgcaugcgccgacccggcgccauuuugguggccgggcgcggaggugauuccacacugaggcgagcgcggcggccggggugguaguggcaguguucgugugcucaggucugaaucgccgagggaggaggcgguggaggaagagguggcggcgguggcgguggucguagcgguggcggaggaggcggguacgaaucagcugcgggcggagacauggccaacaucgcggugcagcgaaucaagcgggaguucaaggaggugcugaagagcgaggagacgagcaaaaaucaaauuaaaguagaucuuguagaugagaauuuuacagaauuaagaggagaaauagcaggaccuccagacacaccauaugaaggaggaagauaccaacuagagauaaaaauaccagaaacauacccauuuaaucccccuaagguccgguuuaucacuaaaauauggcauccuaauauuaguuccgucacaggggcuauuuguuuggauauccugaaagaucaaugggcagcugcaaugacucuccgcacgguauuauugucauugcaagcacuauuggcagcugcagagccagaugauccacaggaugcuguaguagcaaaucaguacaaacaaaaucccgaaauguucaaacagacagcucgacuuugggcacauguguaugcuggagcaccaguuucuaguccagaauacaccaaaaaaauagaaaaccuaugugcuaugggcuuugauaggaaugcaguaauaguggccuugucuucaaaaucaugggauguagagacugcaacagaauugcuucugaguaacugaggcauagagagcugcugauauagucaagcuugccucuucuugaggagcaccaacaucuguuauuuuuaggauucugcauagauuucuuuuaaacuggcauucuugccuaaugauguuaucuaggcaccauuggagacugaaaaaaaaaaaucccugcucuguaaauaaagcuaauuaaacgucuguguaaauuuaaaaaggggaaauacuuuaauuuuuuuucuuaauaguguaaaaauucccugagcuaagcuaaaaccauggaagaaacaugcuacuuuaguguuuagcaguguaccaagacuagcaagaguuugcuucaggauuuuguugaauaauuaagauaauauuuugagugugucagggccauucaaauuguugguguugcaucacagcuaccuuaacuguuuuuaacauggauccucugugccugugaauuuacuugcaugcuuguacuugacuucuuaggauggguagcugaaaagaccaccauuuuaagcauuugagaauucuuaaauaugaaauuuauucagaauugaagauggugaccuauucagagccuuuuuguccuugucaacagacugggacagugucugauucccccuucaccccccccacccccgccuugccacacacagcuaauauucuaaugguaaauuucucuguaucagguggggaaaugugcugaaggacaguauguaucccuugcuucauuuuuaggucguagguuuggaaugucuugucccaguucuucaaacacucuuaaauuuuucuuaaguaauguaaaaauggaacugccaauuuuauuucucuugcaaaaauaguaaauacuugauguuacauuauucccagguuuaaugaaagaacccaacuuaguuuuucagugaauuugacaccuauuuuuuagugaugaaauuuuucuuugagaacuggcaaggaugcagucagcuguuugcaguuuuuagccugauuuuggggucuauagagauugcuuuauuggauacuucaagucauucuugcuugcacuuccccuauugacacaugaaagcuguguugguguuuuauuguacauacuucagaugcacauaggaauagaaguguguuauaaaucuagcuuucuuuaugauguuucugauaauacgagaauugaaaacuuuaccuucucuuguacauagucagacuauuuguauuaaauuuacauuucauucuaaguucaaaaguuugaaaauuauuaguuuugcaagaucacacacuaauguaaccauuuuaugaagguugaaguggauuuaugcaggcaguucuauauauagaaauacaauucuuuuuaaauuuuuaggaccaauacaaaauaacaaaaauguaauggaaucagacugaauuaaaguaaggcuguauauugaaagucauauuauaaaagguuugcuuucuuuaaguguuauuuaucuuaaauuauaaucguuaaauguuuggaagauaauuuuugaaucauaacgucagcauaacuucauuugacuucucaauaaucuugauacuagaagcaauaaaagaaccauuauuaaauauauuguaauguuaaagaugugaagguucuuccaaaaauuuguaaggcuuuccuaauuaacaguaaacucuuauagcugauauuauuacauacuaaacacaaguugcuguuuuuuccccauauguuugcuuacgcaugucuuuauacaaucaccucuuuuuauugcuguaguuuauuuucuaaagaugccaaaggaaacaagauuuuucuuuauuuauuuuaaauaccugaaaccucguacuuuauauuuugaaguaaggugggauugugugaaaauguggaugguuuuucuccaguguugguuagaacuacuuuuuuuaaguggagggcaacuugguaguauuaguagaauuuggguuuaaaaauaucagacacaucuacccaguuuauuuuuugccuguauuaucaggguauauuuaauuguccugugguuaaacaaaggugagagagcucagagguuucuaaaggucaagcauuuuacauauauacauacauacaugcucuuggaggcagcuauauccugcuuugauuuuuaugcacaugagcccuauaggguuauauacucaucuaacuacacuucagcauccccagugcccaagaaauuggaaaguacaauauuugguuugagacauucuucauaaaagauucuuuauuauaaaaauuuaccucauuuacauuuaaugugaugaucuuuuuuuuccuuucugguauauuucccacuguacuguuugguuuuuguuauucucuugucuguggguagauuuaguuacccaaacauagaaacuaaagcaauugcuuuuuuccucuggucuuaaauauguuuggacaaaaagacacuaaaaggucaggccuaggggaaaaguacccugguggaaauuauuuuuguaauucuuaauauuuuugaguuggcuccguuugucaguuuuaaaagccucaaaaauuauguuaaaaaaaaaauccagugaaaucccauuuagggcaggccgauuuguuagaagucacugaugcuccaguaggcuuuuguuauaaucaggccuguuuccugaguaugugccucuuuuaaaagaagaaauaauuagcuguauaguauuucaguacugaugaaugaaugaaugaaugaauggcaguuaguggacccaaauaaguauucagugguauauaaauauuugaggaacuagguacugaauuaggugcucugaguuggcaccccgaaauguuuggaaucacgacuaugauuuacuuaaacacguaacacauucaaggauauauaaauggagucuaaguauuuugcuuuugaagagaauaaucuaugaaauggaagacuugauuuuuuuuuucauuuuuuagaaguaauacacauuuaugauuguuggcacauaaaacuaugcaaaauaauucuuuuuaaguaucuguaagaaagaauuggcaguuuaaacggauuuugcuuauuuaugcacuacagaaugcagcauacuguauuacuguugaggcugcuuaauaaguuuaccaaugugaaaagcagaucuuggguauaaguguaugccugauuugagcuuuuaaaacugugcaguagguguaugguaauguuuuacaauccuauguagcaaaauaggaaauuaugaauuuuuguuguuauuguuuuaaagauuuaagauggauugggguagggaacagcuggagccagguauaccuucuaguauguagagggaaacaauguuuagauaggaaaaaggaagccgucuguuuacaguuaacuuuauuucauggacuucuacaaaauguuguauuaaucacuuuuucuaguucaaggaauuucaauuccaggguacaaaccauugauuuaaaaauuacguuuccauucuuuuuaguaucaguuuaaaguaaaugcuuaccaucagccaguugcugucacugggaagaaggcaacuugaaguauuuacugauaaaauagccuuuauucccaagugugacuuuucuucagugucuacauauuaugucacacguucuauuugcacugcugcaauauagaucaaagaucuuguggcauagggguaggggaguguuaguaucucccuugucccauuuguucuguuacugcuucauuggacugauacacccucaugaacuugcaaucaccuaaauggaagucuugaaugugucaccuuuugcuugguuauuucaaccaugcugcuauauauaaucagguguggcacaguuugucaguuugauuauaggugugaguggauagaaaucauuacacugugcuguuaacgauccuugucugcuugcuguuaccuacuuuuuacaggcaucauaauaaaagcuagacuauuucuuuggggggaaagagacuuauuuaauguaauuuaaaaaacuuuuccaauagaaaaugaaauauuauugaaaauaauaucuauuuuuuagcuuucagcaauugauggugcuuuguuguggugucugcuggaagucuacugccauuauagggaaccuugcuuguuagcuucucuagaucucuauucuaaacaaucuguuagugaugauaaauucuguaggagggucuauucugagccguuaacuuccuguaaggggaaaauggguggguuaccagaaauaccauugaagcagggugggcugugggguggaagguugggguauuugucuugagaauuaaaaacuacgaaacacuuuuguacacaacugauuuuuuaaaaaauaaacacauuuuuaaagauguugaauuuuuccccccuuauugggaauucuuaaaaauaaaugcaugcauguuuuccccugaaaaaaaaaaaaaaaaaa

SEQ ID NO: 224 - RNA, 5130 nt, Homo_Sapiens
acgcgagcucguggcucgggcguaugggggcuccaacgggagcggcugcgccgcccggccgggucaacgucgugcgcaugcgccgacccggcgccauuuugguggccgggcgcggaggugauuccacacugaggcgagcgcggcggccggggugguaguggcaguguucgugugcucaggucugaaucgccgagggaggaggcgguggaggaagagguggcggcgguggcgguggucguagcgguggcggaggaggcggguacgaaucagcugcgggcggagacauggccaacaucgcggugcagcgaaucaagcgggaguucaaggaggugcugaagagcgaggagacgagcaaaaaucaaauuaaaguagaucuuguagaugagaauuuuacagaauuaagaggagaaauagcaggaccuccagacacaccauaugaaggaggaagauaccaacuagagauaaaaauaccagaaacauacccauuuaaucccccuaagguccgguuuaucacuaaaauauggcauccuaauauuaguuccgucacaggggcuauuuguuuggauauccugaaagaucaaugggcagcugcaaugacucuccgcacgguauuauugucauugcaagcacuauuggcagcugcagagccagaugauccacaggaugcuguaguagcaaaucagaaugcaguaauaguggccuugucuucaaaaucaugggauguagagacugcaacagaauugcuucugaguaacugaggcauagagagcugcugauauagucaagcuugccucuucuugaggagcaccaacaucuguuauuuuuaggauucugcauagauuucuuuuaaacuggcauucuugccuaaugauguuaucuaggcaccauuggagacugaaaaaaaaaaaucccugcucuguaaauaaagcuaauuaaacgucuguguaaauuuaaaaaggggaaauacuuuaauuuuuuuucuuaauaguguaaaaauucccugagcuaagcuaaaaccauggaagaaacaugcuacuuuaguguuuagcaguguaccaagacuagcaagaguuugcuucaggauuuuguugaauaauuaagauaauauuuugagugugucagggccauucaaauuguugguguugcaucacagcuaccuuaacuguuuuuaacauggauccucugugccugugaauuuacuugcaugcuuguacuugacuucuuaggauggguagcugaaaagaccaccauuuuaagcauuugagaauucuuaaauaugaaauuuauucagaauugaagauggugaccuauucagagccuuuuuguccuugucaacagacugggacagugucugauucccccuucaccccccccacccccgccuugccacacacagcuaauauucuaaugguaaauuucucuguaucagguggggaaaugugcugaaggacaguauguaucccuugcuucauuuuuaggucguagguuuggaaugucuugucccaguucuucaaacacucuuaaauuuuucuuaaguaauguaaaaauggaacugccaauuuuauuucucuugcaaaaauaguaaauacuugauguuacauuauucccagguuuaaugaaagaacccaacuuaguuuuucagugaauuugacaccuauuuuuuagugaugaaauuuuucuuugagaacuggcaaggaugcagucagcuguuugcaguuuuuagccugauuuuggggucuauagagauugcuuuauuggauacuucaagucauucuugcuugcacuuccccuauugacacaugaaagcuguguugguguuuuauuguacauacuucagaugcacauaggaauagaaguguguuauaaaucuagcuuucuuuaugauguuucugauaauacgagaauugaaaacuuuaccuucucuuguacauagucagacuauuuguauuaaauuuacauuucauucuaaguucaaaaguuugaaaauuauuaguuuugcaagaucacacacuaauguaaccauuuuaugaagguugaaguggauuuaugcaggcaguucuauauauagaaauacaauucuuuuuaaauuuuuaggaccaauacaaaauaacaaaaauguaauggaaucagacugaauuaaaguaaggcuguauauugaaagucauauuauaaaagguuugcuuucuuuaaguguuauuuaucuuaaauuauaaucguuaaauguuuggaagauaauuuuugaaucauaacgucagcauaacuucauuugacuucucaauaaucuugauacuagaagcaauaaaagaaccauuauuaaauauauuguaauguuaaagaugugaagguucuuccaaaaauuuguaaggcuuuccuaauuaacaguaaacucuuauagcugauauuauuacauacuaaacacaaguugcuguuuuuuccccauauguuugcuuacgcaugucuuuauacaaucaccucuuuuuauugcuguaguuuauuuucuaaagaugccaaaggaaacaagauuuuucuuuauuuauuuuaaauaccugaaaccucguacuuuauauuuugaaguaaggugggauugugugaaaauguggaugguuuuucuccaguguugguuagaacuacuuuuuuuaaguggagggcaacuugguaguauuaguagaauuuggguuuaaaaauaucagacacaucuacccaguuuauuuuuugccuguauuaucaggguauauuuaauuguccugugguuaaacaaaggugagagagcucagagguuucuaaaggucaagcauuuuacauauauacauacauacaugcucuuggaggcagcuauauccugcuuugauuuuuaugcacaugagcccuauaggguuauauacucaucuaacuacacuucagcauccccagugcccaagaaauuggaaaguacaauauuugguuugagacauucuucauaaaagauucuuuauuauaaaaauuuaccucauuuacauuuaaugugaugaucuuuuuuuuccuuucugguauauuucccacuguacuguuugguuuuuguuauucucuugucuguggguagauuuaguuacccaaacauagaaacuaaagcaauugcuuuuuuccucuggucuuaaauauguuuggacaaaaagacacuaaaaggucaggccuaggggaaaaguacccugguggaaauuauuuuuguaauucuuaauauuuuugaguuggcuccguuugucaguuuuaaaagccucaaaaauuauguuaaaaaaaaaauccagugaaaucccauuuagggcaggccgauuuguuagaagucacugaugcuccaguaggcuuuuguuauaaucaggccuguuuccugaguaugugccucuuuuaaaagaagaaauaauuagcuguauaguauuucaguacugaugaaugaaugaaugaaugaauggcaguuaguggacccaaauaaguauucagugguauauaaauauuugaggaacuagguacugaauuaggugcucugaguuggcaccccgaaauguuuggaaucacgacuaugauuuacuuaaacacguaacacauucaaggauauauaaauggagucuaaguauuuugcuuuugaagagaauaaucuaugaaauggaagacuugauuuuuuuuuucauuuuuuagaaguaauacacauuuaugauuguuggcacauaaaacuaugcaaaauaauucuuuuuaaguaucuguaagaaagaauuggcaguuuaaacggauuuugcuuauuuaugcacuacagaaugcagcauacuguauuacuguugaggcugcuuaauaaguuuaccaaugugaaaagcagaucuuggguauaaguguaugccugauuugagcuuuuaaaacugugcaguagguguaugguaauguuuuacaauccuauguagcaaaauaggaaauuaugaauuuuuguuguuauuguuuuaaagauuuaagauggauugggguagggaacagcuggagccagguauaccuucuaguauguagagggaaacaauguuuagauaggaaaaaggaagccgucuguuuacaguuaacuuuauuucauggacuucuacaaaauguuguauuaaucacuuuuucuaguucaaggaauuucaauuccaggguacaaaccauugauuuaaaaauuacguuuccauucuuuuuaguaucaguuuaaaguaaaugcuuaccaucagccaguugcugucacugggaagaaggcaacuugaaguauuuacugauaaaauagccuuuauucccaagugugacuuuucuucagugucuacauauuaugucacacguucuauuugcacugcugcaauauagaucaaagaucuuguggcauagggguaggggaguguuaguaucucccuugucccauuuguucuguuacugcuucauuggacugauacacccucaugaacuugcaaucaccuaaauggaagucuugaaugugucaccuuuugcuugguuauuucaaccaugcugcuauauauaaucagguguggcacaguuugucaguuugauuauaggugugaguggauagaaaucauuacacugugcuguuaacgauccuugucugcuugcuguuaccuacuuuuuacaggcaucauaauaaaagcuagacuauuucuuuggggggaaagagacuuauuuaauguaauuuaaaaaacuuuuccaauagaaaaugaaauauuauugaaaauaauaucuauuuuuuagcuuucagcaauugauggugcuuuguuguggugucugcuggaagucuacugccauuauagggaaccuugcuuguuagcuucucuagaucucuauucuaaacaaucuguuagugaugauaaauucuguaggagggucuauucugagccguuaacuuccuguaaggggaaaauggguggguuaccagaaauaccauugaagcagggugggcugugggguggaagguugggguauuugucuugagaauuaaaaacuacgaaacacuuuuguacacaacugauuuuuuaaaaaauaaacacauuuuuaaagauguugaauuuuuccccccuuauugggaauucuuaaaaauaaaugcaugcauguuuuccccugaaaaaaaaaaaaaaaaaa

SEQ ID NO: 225 - RNA, 5106 nt, Homo_Sapiens
acgcgagcucguggcucgggcguaugggggcuccaacgggagcggcugcgccgcccggccgggucaacgucgugcgcaugcgccgacccggcgccauuuugguggccgggcgcggaggugauuccacacugaggcgagcgcggcggccggggugguaguggcaguguucgugugcucaggucugaaucgccgagggaggaggcgguggaggaagagguggcggcgguggcgguggucguagcgguggcggaggaggcggguacgaaucagcugcgggcggagacauggccaacaucgcggugcagcgaaucaagcgggaguucaaggaggugcugaagagcgaggagguccgguuuaucacuaaaauauggcauccuaauauuaguuccgucacaggggcuauuuguuuggauauccugaaagaucaaugggcagcugcaaugacucuccgcacgguauuauugucauugcaagcacuauuggcagcugcagagccagaugauccacaggaugcuguaguagcaaaucaguacaaacaaaaucccgaaauguucaaacagacagcucgacuuugggcacauguguaugcuggagcaccaguuucuaguccagaauacaccaaaaaaauagaaaaccuaugugcuaugggcuuugauaggaaugcaguaauaguggccuugucuucaaaaucaugggauguagagacugcaacagaauugcuucugaguaacugaggcauagagagcugcugauauagucaagcuugccucuucuugaggagcaccaacaucuguuauuuuuaggauucugcauagauuucuuuuaaacuggcauucuugccuaaugauguuaucuaggcaccauuggagacugaaaaaaaaaaaucccugcucuguaaauaaagcuaauuaaacgucuguguaaauuuaaaaaggggaaauacuuuaauuuuuuuucuuaauaguguaaaaauucccugagcuaagcuaaaaccauggaagaaacaugcuacuuuaguguuuagcaguguaccaagacuagcaagaguuugcuucaggauuuuguugaauaauuaagauaauauuuugagugugucagggccauucaaauuguugguguugcaucacagcuaccuuaacuguuuuuaacauggauccucugugccugugaauuuacuugcaugcuuguacuugacuucuuaggauggguagcugaaaagaccaccauuuuaagcauuugagaauucuuaaauaugaaauuuauucagaauugaagauggugaccuauucagagccuuuuuguccuugucaacagacugggacagugucugauucccccuucaccccccccacccccgccuugccacacacagcuaauauucuaaugguaaauuucucuguaucagguggggaaaugugcugaaggacaguauguaucccuugcuucauuuuuaggucguagguuuggaaugucuugucccaguucuucaaacacucuuaaauuuuucuuaaguaauguaaaaauggaacugccaauuuuauuucucuugcaaaaauaguaaauacuugauguuacauuauucccagguuuaaugaaagaacccaacuuaguuuuucagugaauuugacaccuauuuuuuagugaugaaauuuuucuuugagaacuggcaaggaugcagucagcuguuugcaguuuuuagccugauuuuggggucuauagagauugcuuuauuggauacuucaagucauucuugcuugcacuuccccuauugacacaugaaagcuguguugguguuuuauuguacauacuucagaugcacauaggaauagaaguguguuauaaaucuagcuuucuuuaugauguuucugauaauacgagaauugaaaacuuuaccuucucuuguacauagucagacuauuuguauuaaauuuacauuucauucuaaguucaaaaguuugaaaauuauuaguuuugcaagaucacacacuaauguaaccauuuuaugaagguugaaguggauuuaugcaggcaguucuauauauagaaauacaauucuuuuuaaauuuuuaggaccaauacaaaauaacaaaaauguaauggaaucagacugaauuaaaguaaggcuguauauugaaagucauauuauaaaagguuugcuuucuuuaaguguuauuuaucuuaaauuauaaucguuaaauguuuggaagauaauuuuugaaucauaacgucagcauaacuucauuugacuucucaauaaucuugauacuagaagcaauaaaagaaccauuauuaaauauauuguaauguuaaagaugugaagguucuuccaaaaauuuguaaggcuuuccuaauuaacaguaaacucuuauagcugauauuauuacauacuaaacacaaguugcuguuuuuuccccauauguuugcuuacgcaugucuuuauacaaucaccucuuuuuauugcuguaguuuauuuucuaaagaugccaaaggaaacaagauuuuucuuuauuuauuuuaaauaccugaaaccucguacuuuauauuuugaaguaaggugggauugugugaaaauguggaugguuuuucuccaguguugguuagaacuacuuuuuuuaaguggagggcaacuugguaguauuaguagaauuuggguuuaaaaauaucagacacaucuacccaguuuauuuuuugccuguauuaucaggguauauuuaauuguccugugguuaaacaaaggugagagagcucagagguuucuaaaggucaagcauuuuacauauauacauacauacaugcucuuggaggcagcuauauccugcuuugauuuuuaugcacaugagcccuauaggguuauauacucaucuaacuacacuucagcauccccagugcccaagaaauuggaaaguacaauauuugguuugagacauucuucauaaaagauucuuuauuauaaaaauuuaccucauuuacauuuaaugugaugaucuuuuuuuuccuuucugguauauuucccacuguacuguuugguuuuuguuauucucuugucuguggguagauuuaguuacccaaacauagaaacuaaagcaauugcuuuuuuccucuggucuuaaauauguuuggacaaaaagacacuaaaaggucaggccuaggggaaaaguacccugguggaaauuauuuuuguaauucuuaauauuuuugaguuggcuccguuugucaguuuuaaaagccucaaaaauuauguuaaaaaaaaaauccagugaaaucccauuuagggcaggccgauuuguuagaagucacugaugcuccaguaggcuuuuguuauaaucaggccuguuuccugaguaugugccucuuuuaaaagaagaaauaauuagcuguauaguauuucaguacugaugaaugaaugaaugaaugaauggcaguuaguggacccaaauaaguauucagugguauauaaauauuugaggaacuagguacugaauuaggugcucugaguuggcaccccgaaauguuuggaaucacgacuaugauuuacuuaaacacguaacacauucaaggauauauaaauggagucuaaguauuuugcuuuugaagagaauaaucuaugaaauggaagacuugauuuuuuuuuucauuuuuuagaaguaauacacauuuaugauuguuggcacauaaaacuaugcaaaauaauucuuuuuaaguaucuguaagaaagaauuggcaguuuaaacggauuuugcuuauuuaugcacuacagaaugcagcauacuguauuacuguugaggcugcuuaauaaguuuaccaaugugaaaagcagaucuuggguauaaguguaugccugauuugagcuuuuaaaacugugcaguagguguaugguaauguuuuacaauccuauguagcaaaauaggaaauuaugaauuuuuguuguuauuguuuuaaagauuuaagauggauugggguagggaacagcuggagccagguauaccuucuaguauguagagggaaacaauguuuagauaggaaaaaggaagccgucuguuuacaguuaacuuuauuucauggacuucuacaaaauguuguauuaaucacuuuuucuaguucaaggaauuucaauuccaggguacaaaccauugauuuaaaaauuacguuuccauucuuuuuaguaucaguuuaaaguaaaugcuuaccaucagccaguugcugucacugggaagaaggcaacuugaaguauuuacugauaaaauagccuuuauucccaagugugacuuuucuucagugucuacauauuaugucacacguucuauuugcacugcugcaauauagaucaaagaucuuguggcauagggguaggggaguguuaguaucucccuugucccauuuguucuguuacugcuucauuggacugauacacccucaugaacuugcaaucaccuaaauggaagucuugaaugugucaccuuuugcuugguuauuucaaccaugcugcuauauauaaucagguguggcacaguuugucaguuugauuauaggugugaguggauagaaaucauuacacugugcuguuaacgauccuugucugcuugcuguuaccuacuuuuuacaggcaucauaauaaaagcuagacuauuucuuuggggggaaagagacuuauuuaauguaauuuaaaaaacuuuuccaauagaaaaugaaauauuauugaaaauaauaucuauuuuuuagcuuucagcaauugauggugcuuuguuguggugucugcuggaagucuacugccauuauagggaaccuugcuuguuagcuucucuagaucucuauucuaaacaaucuguuagugaugauaaauucuguaggagggucuauucugagccguuaacuuccuguaaggggaaaauggguggguuaccagaaauaccauugaagcagggugggcugugggguggaagguugggguauuugucuugagaauuaaaaacuacgaaacacuuuuguacacaacugauuuuuuaaaaaauaaacacauuuuuaaagauguugaauuuuuccccccuuauugggaauucuuaaaaauaaaugcaugcauguuuuccccugaaaaaaaaaaaaaaaaaa

SEQ ID NO: 226 - RNA, 6299 nt, Homo_Sapiens
agagcgugcguucgguggcccauaggggaagauggcggcugcuccuuuggaggagcgggauugagaggaucgggguggggagaccaaacaagagagacauuucuggcucugaaggcgaacgcuucgcuggccauuuaggagcucugcucaaagccagacguauccuagaaggaaaacaucaccauggcuacagaaauugguucuccuccucguuuuuuccauaugccaagguuccagcaccaggcaccucgacagcuguuuuauaagcgaccugauuuugcacaacagcaagcaaugcaacagcuuacuuuugauggaaaacgaaugagaaaagcugugaaccgaaaaaccauagacuacaauccaucuguaauuaaguauuuggagaacagaauauggcaaagagaccagagagauaugcgggcaauucagccugaugcagguuauuacaaugaucuggucccaccuauaggaauguugaauaauccuaugaaugcaguaacaacaaaauuuguucggacaucaacaaauaaaguaaaguguccuguauuuguuguuagguggacuccagaaggaagacgcuuggucacuggagcuucuaguggggaguuuacccuguggaauggacucacuuucaauuuugaaacaauauuacaggcucacgacagcccagugagggccaugacguggucacauaaugacauguggauguugacagcagaccacggaggauaugugaaauauuggcagucgaacaugaacaacgucaagauguuccaggcacauaaggaggcgauuagagaggccaguuucucacccacggauaauaaauuugcuacaugcucugaugacggcacuguuagaaucugggacuuucuucguugccaugaggaaagaauucuccgagggcauggugcugaugugaaauguguagacuggcauccaaccaaaggguuaguuguuucaggaaguaaagauagucaacagccaaucaaguucugggaucccaagacugggcagagucuugcaacacuucaugcccauaaaaacacaguaauggaagugaaauuaaaccucaauggcaauuggcuacucacagcaucacgugaucaucucuguaaacuuuuugauaucagaaaccuaaaagaagagcuucaagucuuccgaggucauaagaaagaagccacagcuguggccuggcauccuguucaugaaggacuuuuugccaguggagggucugaugguucuuuguuauucuggcauguugggguagagaaggaagugggugggauggagauggcucacgaagggaugaucuggagucuggcuuggcauccucuugggcauauucucugcucaggcucaaaugaccauacuagcaaauucuggacucgaaaccgaccaggugauaaaaugcgagaucgauauaaucuaaaccuuuuaccuggaaugucugaagauggaguagaauaugaugaccucgaaccuaauagccuggcaguaauuccaggaaugggaauaccagaacaacuaaaauuagcuauggaacaagaacagauggggaaagaugaaucaaaugaaauugaaaugacaauuccagguuuagauuggggaauggaggaagugaugcaaaaggaucagaaaaaaguaccucagaagaaaguuccuuaugcaaaacccauuccugcucaguuccagcaggcuuggaugcaaaauaaaguuccaauuccugcuccaaaugaggugcugaaugacagaaaagaagacauuaaauuggaagagaagaaaaaaacacaagcagaaauugagcaagaaauggcuacauuacaauauacuaacccacaacuucuggagcaacuuaaaauugaaagacuugcacagaaacaaguugagcaaauucagccuccucccucaucuggcaccccucuccucggaccccagccuuuuccaggacaagguccaaugucucagauuccucaagguuuucaacagccccauccaucucagcagaugccaaugaacauggcucaaauggggccuccagguccacagggacaguuuaggccuccuggaccccagggacaaaugggaccacaagguccuccacugcaucagggagguggggggccacaaggauucaugggaccacaggggccccagggcccgccccagggguugccacggccucaggacaugcaugggccccaaggaaugcagaggcauccuggaccucauggcccuuugggaccucaagggccaccuggaccacaagguaguucugguccucaaggucauauggguccucaggguccaccuggcccacagggucacauaggcccccaaggcccgccuggcccucagggucacuugggcccacaggggccuccggguacucaagguaugcagggaccaccuggucccagaggaaugcaagggccuccucauccucaugggauccaaggcggaccagggucucaagggauccaagguccugugucucagggaccucugaugggauugaauccaagaggaaugcaggggccuccaggcccccgggagaaccaggguccugcuccccaagggaugauuaugggccacccgccucaagagaugagaggaccucacccuccagguggacuacugggacacggcccucaggaaaugagagguccucaggagauccgaggcaugcaggggccuccaccccaaggaucaaugcugggaccuccccaggaauugcgagggccuccaggcucacaaagucagcaggggccgccccagggcucuuuaggaccuccaccccaggguggcaugcaaggaccccccggaccucagggacagcagaacccagcaagagggccacauccaucucaagggccaauaccauuccagcaacagaaaacgccucugcuaggugaugggccccgggcccccuucaaccaggaaggacagagcacaggccccccaccccugauaccaggccuagggcagcagggagcacaaggucgcauucccccucugaaccccggacaaggaccuggccccaacaaaggugacucccgcggcccuccaaaccaucacaugggcccgaugucagagaggcggcaugagcagagcggcgggccugagcaugggcccgagagggggccuuuccgggguggccaggacugcaggggucccccugauaggcguggcccucacccagacuuccccgaugacuucagcagaccagaugacuuccacccugacaagcgcuuuggccaccgguuacgugaauuugaggggcgaggaggaccuuuaccgcaagaagagaaguggaggcgagggggcccugggccuccguuucccccugaucacagggaauucagcgagggggauggccggggugcagcccgaggcccuccgggggcaugggaaggccgcaggcccggagaugaacguuucccccgggaucccgaggacccacguuuucgagggcgcagagaagaaaguuucagaagaggagccccgccgaggcaugagggccgugcuccccccagaggaagggaugguuuuccugguccugaagacuuugguccagaggagaauuuugaugcuucugaggaagcggcccgaggacgagaucucagaggucgaggucgggguaccccacgaggaggaaggaaggguuuacuucccacuccugacgaguucccucgcuuugaaggagggcggaagccagauuccugggauggaaacagagagccugggccaggucaugaacauuuucgugauacuccccgcccugaucaucccccucacgacggucauuccccagccagcagagaacgcuccucuucucuccaaggcauggacauggcaucccuaccuccccgaaagcgccccuggcaugauggcccaggcacuucugagcacagagagauggaggccccaggaggcccuucugaagaccgaggaggcaaaggccgagggggcccaggaccugcucagagagugcccaaaucugggcguuccagcuccuuagacggagagcaccacgauggauaccacagagaugaaccuuuugggggcccuccaggcaguggcaccccuucucgagggggccggaguggcaguaacugggguagagggaguaacaugaacucuggcccgccgaggcgaggagcuucacggggugguggaaggggucgguagaagcuggaacugaguacccugaggccucucuggacaguauguaagaacuucuuguggacucaccaagagaaacaaaaggaagccugcaccauuguagcccugaacucuuuucugggcaccugaaucccaggaacccucaaugaggucuucaagaugaagagacugcugccagcuaccagccuggcuggcccuguccuguccacccucauugccccaacucccauguuguuuugugaagauaaaagcugggaucuuuuucuuuuuuuuaagucucacaagacauggggcaucuccacaaauuuaaguuccuguccauuuggaaauuuguuucuauguguacaguuugucagagaaaaacaaaguuuuuguaugaauacagaaugugauuuacgcaagaauugacagaaaacuaguugugaagugcuugccuuaaggaaaccuuugguuuccaucgcaucccaucugccaaggaaugcacgguuguugcugauguucaugagcauauuaaccacuagguuaucuaaauuaaucucagcugugaacuuuguguuuuucaacacauucugucacaccauuuuugugacagaaaaauacuugaaaauuauucuaauguaguuuguaguagguucaaauuuuuauucagacaugcucugacagauggaaaauuguacucugaagagaaaaugcaaucuucuggauguccaacgagggagcuuccccuuggaagcaucuccuaagaaucacaguuuagguuugaaucgccuuguuaugaugaggagaggaacuugauguuagucagaaauaaagucacaugcccuuuagauaacuugaaaucacacauggaguugauaaggaauggaccaaaauagguccucaaacaauuuugcaacacuuaauuaaguuuuccucucuuccucuuccauacuauguggaaauaccaguguuacggcagggcguacuucuaacucacaguaagccagauagaucuuguccauggcaaauuccuuguuuaaaauaaacauaccauuuagcccaguuuggauuggaagccaaaaauucaguuuguuauauaccccaugauacuuucuauacugaccuuuauuuugguuuuacauggaagcuuuuauuaaaaggacuguccuauggccaccuuaacauuucauuacauuggcagcuucaguuuuggcaucagucaaauuuauuuggcaaauuuaguggugcuggaaguuucuuuuuuucuuuuccuuuuuugacagagucuugcucugucacccagccaggagugcaguggugcaaucacggcucacuucagcuuugacccugccucagccucccuaguagcuaggacuacaggcauaugccaccaugcccagcuaauuuuuuguguguguguuuuuuguagagauggaguuucaccacuuugucuaugcugguuucaaacuccugggcucaagcgguccaccugcuguggccucccaaagugcugggauugcagaucugagccacaguaccuggccgcuggugcuggaaguuucaaugguugcuuagaaaaggcauacugauauaguuuaacaggauaugaaaauuuaacugguucucuaugaauguaaaaaacagcaaaagcuaauugauuucuguggagugagaaaaugucagccauauacacugcuuuucaguguuagaaucuagagacuauuuuuuuuuuaacuuugaaauuacagcuuauuuaaucagcgcuccaccauaaacaugcuauuaggaggcucaagauugcuuuagguuauggguauuucuucacucacccccaacugguauagcuuaaagagagagaaacuguaaucaaauuucaugaagcuaaaaccggauccagagaccaaacccauaucaagauuagacuuuuuuucccugagauucuaguggaaaaauuuucauuauuuugggcuuuaacuuuagaaacauaguaucucaguaagcagauaaccagaucacauuuaaaaauuuucauuuuaccuugaagcucuacuggacuugacagaucacauuuugagagugaauucauuuaaacaauaaaccucuacauuauacuuauaaaaaaaaaaaaaaaa

SEQ ID NO: 227 - RNA, 1174 nt, Homo_Sapiens
agagcgugcguucgguggcccauaggggaagauggcggcugcuccuuuggaggagcgggauugagaggaucgggguggggagaccaaacaagagagacauuucuggcucugaaggcgaacgcuucgcuggccauuuaggagcucugcucaaagccagacguauccuagaaggaaaacaucaccauggcuacagaaauugguucuccuccucguuuuuuccauaugccaagguuccagcaccaggcaccucgacagcuguuuuauaagcgaccugauuuugcacaacagcaagcaaugcaacagcuuacuuuugauggaaaacgaaugagaaaagcugugaaccgaaaaaccauagacuacaauccaucuguaauuaaguauuuggagaacagaauauggcaaagagaccagagagauaugcgggcaauucagccugaugcagguuauuacaaugaucuggucccaccuauaggaauguugaauaauccuaugaaugcaguaacaacaaaauuuguucggacaucaacaaauaaaguaaaguguccuguauuuguuguuagguggacuccagaaggaagacgcuuggucacuggagcuucuaguggggaguuuacccuguggaauggacucacuuucaauuuugaaacaauauuacaggcucacgacagcccagugagggccaugacguggucacauaaugacauguggauguugacagcagaccacggaggauaugugaaauauuggcagucgaacaugaacaacgucaagauguuccaggcacauaaggaggcgauuagagaggccagguuuauacacaauauaccauuuucuguagucccuauugucaugguuaaauuauucucuaaguguauucugggugcagagaugcaugggcucugucaguuucugggaaacuuucugcacccuauaaacacaauauuuuucuuuguuuucacacauucaccauuuugcuggcaccuuucugaaguaguguugucccgguaucagccuuugcaauauguuagagauguacugucugccgcauuuugcacugguuuucucuuuucauuuaugauuaauaauguguauacguuauuccuuuuuauuaucuacuguguaagacaagaauauuucauuccaaauaaagaauucagucuuuaauuaugaaaaa

SEQ ID NO: 228 - RNA, 3574 nt, Homo_Sapiens
agagcgugcguucgguggcccauaggggaagauggcggcugcuccuuuggaggagcgggauugagaggaucgggguggggagaccaaacaagagagacauuucuggcucugaaggcgaacgcuucgcuggccauuuaggagcucugcucaaagccagacguauccuagaaggaaaacaucaccauggcuacagaaauugguucuccuccucguuuuuuccauaugccaagguuccagcaccaggcaccucgacagcuguuuuauaagcgaccugauuuugcacaacagcaagcaaugcaacagcuuacuuuugauggaaaacgaaugagaaaagcugugaaccgaaaaaccauagacuacaauccaucuguaauuaaguauuuggagaacagaauauggcaaagagaccagagagauaugcgggcaauucagccugaugcagguuauuacaaugaucuggucccaccuauaggaauguugaauaauccuaugaaugcaguaacaacaaaauuuguucggacaucaacaaauaaaguaaaguguccuguauuuguuguuagguggacuccagaaggaagacgcuuggucacuggagcuucuaguggggaguuuacccuguggaauggacucacuuucaauuuugaaacaauauuacaggcucacgacagcccagugagggccaugacguggucacauaaugacauguggauguugacagcagaccacggaggauaugugaaauauuggcagucgaacaugaacaacgucaagauguuccaggcacauaaggaggcgauuagagaggccaguuucucacccacggauaauaaauuugcuacaugcucugaugacggcacuguuagaaucugggacuuucuucguugccaugaggaaagaauucuccgagauacauguuuucaucacugccguuguuacuuccuuucugucaagaggugaauaacaguagguggacaaaguuuagggagccacauuuaccaacuucugugaauauacccaagaagauucuggcaaaacauagauucaaauuacaguugaugcuguggauggcuauggguuaacuacucuucuacuuugacacggauuauuuguugcuuuuauguuucuaaauucucaauuaaaaagaaguguauccuuaaucuggccaacugaaagugaacuuguucauucaccucuaccuugcuuucaaaaggacugcuuaccauggaagugcuccagaagaaucauuugaaacaucuuuuguuuuccuucuugguucugcguuuucuuccuuaccaggggcuucagucauggcuucucuuuauucuuggccuggguugucugcuggcacuaauacaucuauuauuaacguaguguagguacuggccuuucuaauagucuugguauuuagugccagacucccaucaaucuuuugaaugucuuuucuuuuucuuuuugcacuuuucuagcuuuucaagugaugacuauauacugcuuuucuugacuguauauauuguuacugaauugugaauaucugcagaaauguuuacuagagaaccugugacuguugaauaacaugugcccgaacauacacacacacauauguacacacacaccucagaguacucuuucuuacagcggacuuugcugcugcuuucugcaugugugggacacugguaucucccgucucagacaaauggcugauguucucuaugauauugguguuaauaucaaagaauugaaugaauacaacagaauugagguugaaaaauauuugauugccacauuccuuuaagcaucuuugaugaauacucugcaaaguagccuuuaaaaaaauguaaauuuuuuaaaaaguccacagaggagaauuugcugguuagcacaaaacauacugcaaaauugcuucuuucugguuauuauaacugaagaauauagaagauugacacacauuuuauacacccucaggcaguguuuuggaauaauauuguaccuuuucaaauuguuaucaauuaacuguuuuucuccauuucauaauucucaagauuuuucuaaauacagccuuuaaauuugacucaaauggaaauugugcacuuuccuguuuauacccuuccccacguuauuguaaaagaguuuaacagcagccugauauguaaguuucagcaaaacuuauaccuguauauguuuuuauuugacucaaaaauuagauauuuuaccauauagucauaagaauuugcucacuuugaugccagaaguacuuaagaaguuacacggcacuaauuuuaugaguuguaugccuaauuucaauuucuaaccuauuugacaguuucuuuuaggucagccuuuguuggucuuccauguaaauacaaguugguacaaaucaauagaaaccauuuuaccuacauaggcaaaguaaaugugugacuuagagacugccagauuuauggugcaucuaccuuuuuauccauuugagcuugcuuuuuuauguuuguguauugguugcuccugacacuauacauuucaaaauuuuuuauaacuugaaaaacacuucugugcuaccacucaguucugaucaaauccuuacauuuugcaacacucauuucugaauuuucaguaaagaaauacacauuacaaauuaaagguuaaaggccccuuuacaugcccuuccccagucuccucuuccucccccggaaguguccauucugcugaauucagguucaucauugccagacaaauguaguaagcuaguguuucacauuuccaaaaucagccuucuggcagacuuggaaguacucuugagaaaagaagacucgugaccaaauucucccacagauuuguaauaauguacauauugaaaggacugaaggcucucagacugggaaagaaacuuacccauuuuaaaauucagcauugcucaacuuaccugacugccggaccccuucacccaugauucuaugcacuguauuguuggaacauacauugugaaaacacugcccugccuaggcauacccccuuuccagaauuaacuuuccauuuaauucuauaguuuuucacugauguaacuuucuagacuggacaacaaagaugacuaauaguaaucacuccaaguugauguugacuguuggguuguggugaaaucauuuugcauuaaaggaagguaaaauacuaauaaauugcauauuccuugaccagagcacagauuacuuaugcuucuuaauuuuuuaaaaucuuaaauccucuguccaacuggaguaucuggcuaugggccauggguacucauauacccuuugucuuaaacugaucuguuacauuuuauguucuuguggcuagaaguagccugaguuugcuguuaauguuuaacacauuuucuugaguaacaguucuguuaauauuguacaagaugguacuugaauucuuuguuugccuuuuuucuuccuguauuagaaaaucuuggugcuuuuuauaaguuuuguauaaaagaauuuuuuuuaagauuuguucauaaaauggucugauccaggaaaaauaaaaugggaacauggacaccauuucugaccuucaaauaaaacuuauuauguau

SEQ ID NO: 229 - RNA, 15025 nt, Homo_Sapiens
cggcggcaguggcggcaccgccuccuccucacauucccgggguggcgggguuagaugagcggccccaguagcggcgagggcggcgcgggggggaggaggagaagaaggaggaggagaaggaggucgcugucuuuguagucucccugcugcgggagccagaggccgccgccggagccgucgucguuggaaaagggcugugugugcgcgcgcgugucugcccgcccggcccgcggggacgaggcggcggcggcggcggcggcggcgaggaugaugaugugcgcagcgacugccucccccgccgccgccuccucggggcucggcggggacggauucuacccagccgccaccuucucuuccuccccggcgccgggggcgcuguucaugccgguucccgacggcuccguggcugcugcggggcuggggcuggggcuacccgccgcggacucccggggucacuaccagcugcugcugucaggccgggcccuggccgaccgcuaccggaggauuuauaccgcugcgcucaaugacagggaccaggggggcggcagcgcuggacacccagccuccaggaauaagaaaauuuuaaauaagaagaaauugaaaagaaaacagaagagcaaaucaaaagugaagacaagaagcaagucugaaaacuuagagaauacaguaaucauaccagauaucaaacuacauagcaauccuucugcuuucaauauuuacuguaauguacgccauugcguucuggaauggcagaaaaaggaaauaucauuggcagccgcaucuaagaacucugugcagaguggagaaucagauagugaugaagaagaggaauccaaagagcccccuaucaagcuuccaaagauuauugagguuggccuuugugaaguuuuugaauugaucaaagagacacgauuuucucauccaucccugugucucaggagucuccaagcccugcucaacgugcugcagggccagcagccagaaggccuccagucugagccaccugagguccuagagucucucuuccagcuucuuuuggaaaucaccguucgaaguacugggaugaaugacagcacaggacaguccuuaacagcacuuuccugugcuugccucuuuagucugguggcuucuuggggagaaacaggaaggacacuucaggccaucucugcuauccucaccaacaauggaagccaugcuugccaaacuauucaggugccaacaauucuaaauucgcuacagagaaguguacaagcaguuuuggugggaaaaauucaaauucaggacugguuuaguaauggcauuaagaaagcagcuuuaaugcacaaguggccauuaaaagaaauaucuguugaugaagaugaccaaugucuacuucagaaugauggauuuuuucuuuaucuauuaugcaaggauggauuauauaaaauaggcucuggauacaguggaacaguuaggggccauauauacaauucuacaucccguauuagaaacagaaaagaaaaaaagucuugguuaggguaugcucaggguuauuuauuauauagagaugugaauaaccacagcaugacagccauaaggauaagcccugaaacacuggagcaagaugguacugugauguuaccagauugccacacugaaggucaaaauauuuuauucacugauggagaauauauuaaucagauagcugcuucaagagaugauggcuuuguugucagaauauuugccacaagcacugaaccuguucuacagcaagaauugcaacuuaaacuggcuagaaaaugcuuacaugccugugguaucucacuauucgaucuggaaaaggacuugcauauuauaaguacaggauuugaugaggagucagcaauucuuggugcaggacgagaguuugcgcuaaugaaaacagcaaauggaaagauauauuacacuggcaaauaccagagucuuggaaucaaacaaggugguccuucagcaggaaaauggguugagcuaccaauuacaaaaucuccaaagauaguacacuucucaguuggacacgauggcucucacgcccuuuuaguugcagaagaugggagcauauucuuuacaggaucugcuaguaaaggagaagauggagaaucaacuaagagcagacggcaauccaaaccuuauaaaccuaaaaagauaauuaagauggaaggaaagauugugguauauacagccugcaauaauggaaguaguucuguuauuucuaaagauggagaacucuacauguuuggaaaagaugccauuuacucugauaguucaaguuugguaacugauuugaagggccauuuuguaacucagguagcuaugggcaaagcucacacuuguguuuuaaugaagaauggagagguguggacauuugguguaaauaauaaaggacaguguggacgagauacuggugccaugaaccaaggugggaaaggguuuggaguugaaaauauggcaacagcaauggaugaagaccuggaagaagaacuagaugaaaaagaugagaagucuaugaugugcccuccaggcaugcacaaauggaagcuggagcagugcaugguuugcacugucuguggagacuguacagguuauggagccagcugugucaguaguggacggccagacagaguccccggagggaucugugguugugguuccggagaaucugguugugcuguguguggauguugcaaggccugugcaagagaguuagauggucaagaggcaagacaaagaggaauucuugaugcagugaaagaaaugauaccuuuagaucuucuuuuagcugucccagugcccgggguuaacauugaagaacaccuucaguuacgacaagaagaaaaacggcaacguguaaucagaaggcacagauuagaggaaggaagaggcccccuuguauuugcugguccuauuuuuaugaaccaucgagaacaggcucuagccagacucagaucccauccagcacagcuaaagcauaaacgggacaagcacaaagauggaaguggagaaagaggcgaaaaggaugcaagcaaaaucacaacauacccuccaggcucugugcgauuugacugugagcuccgggcaguccaagucagcuguggauuucaccauucagugguuuuaauggaaaauggagaugucuauacauuugguuaugggcagcaugggcagcuaggacauggagaugucaacuccaggggaugucccacucuuguucaagcauugccaggcccuagcacacaagucacugcaggcagcaaccauacggcaguacuuuuaauggauggacaggucuucacauuuggaaguuuuucuaaaggacaacugggcagaccaauuuuggaugugccauauuggaaugcaaagccagcucccaugccuaacauuggaucaaaauauggaagaaaagcuacuuggauaggugcaaguggggaccaaacuuuuuuacgaauugaugaagcacuuauuaauucucauguacuugcuacaucagaaauuuuugccaguaaacacauaauaggcuugguaccugcuucuauaucagaaccuccuccauuuaaaugccuucugauaaauaaaguggaugggaguuguaaaacuuuuaaugacucagaacaagaggaucugcaaggauuuggugugugucuugauccuguauaugauguaauuuggagguuucgaccaaauacuagagagcugugguguuacaaugcggugguugcugaugccaggcuucccucugcagcagacaugcaguccagauguaguauccuaaguccugaacuugccuuaccaacaggaucaagggcccucacuacccgaucucaugcagcuuugcacauuuuagguugucuugauaccuuggcagcuaugcaggacuuaaaaauggguguugcaaguacagaggaagagacucaagcaguaaugaagguuuauucuaaagaagauuauagugugguaaacagguuugaaagucauggaggaggcugggguuauucugcccauucaguagaagcuauacguuucagugccgacacugauauuuuacuugguggucuuggucuguuuggagguagaggagaauauacugcuaaaauuaagcuguuugaauuggguccugauggaggagaucaugaaacugauggugaccuucuugcagagacugauguauuggcuuaugacugugcugcuagagaaaaauaugcaaugauguuugaugagccuguucuccugcaagcuggguggugguauguggcaugggcccgagugucaggacccagcagugacuguggaucucauggacaggcaucuauuaccacagaugaugggguuguuuuccaguucaagaguucaaagaaaucaaauaaugguacagauguuaaugcgggucagauaccucaguuauuauacagacuuccaaccagugauggcagugcuucaaaaggcaaacagcaaaccagugaaccuguacacauuuuaaagaggucuuuugcaagaacugucucaguggaauguuuugagucauuguugaguauucuucacuggagcuggaccaccuuagucuuaggaguugaagaacuuagaggauuaaaaggauuccaguucacagcuacacuccuagauuuagagagacugcgcuuuguggguaccuguugucugagguuauugcgugucuauaccugugaaauuuacccagugucagcuacaggaaaagcaguuguagaagaaacuagcaaauuagcagaguguauuggaaaaaccagaacuuuguuaagaaaaauuuuaucagaaggaguugaucacugcauggugaaauuggauaaugauccucaaggauaucucagucaacccuugagucuucuagaagcuguccuucaggaaugucauaauacuuucacugccugcuuucauucuuucuacccaacuccugccuuacagugggcuugccuuugugaucugcugaauuguuuggaucaggauauccaagaagcaaacuucaagacaucaaguagccgacuccuugcagcuguuaugucagcucugugucacacgucuguuaagcugacuuccaucuucccgauugcguaugauggagaaguauuacuacgaucaauuguuaaacaaguuaguacagagaacgacucaacacuaguucaucguuuuccccuuuugguggcacauauggaaaaacucagccagagugaagagaauaucucagggaugacaagcuuccgugaaguucuggagaaaaugcuggucauuguugugcuaccagucaggaacagccugaggagagaaaaugaacucuucuccucccaccucgucucuaacaccuguggauuacuggccagcauugucagugaacugacagcgucagcccugggaucugagguugauggacuuaauucucuucacucuguaaaagcuagugcuaaccgauuuacaaaaacaagucagggcagaaguuggaacacugggaacggguccccugaugcaaucuguuuuucaguagacaaaccuggaauaguugugguugguuucucugucuauggaggagguggaauucaugaauaugaauuagagguguugguugaugauagugaacaugcaggagauucaacucauucccacagauggacaucucuggaauuagugaaaggaacguacacaacggaugacucacccagugauauagcugagaucagacuugacaaagugguuccuuuaaaggaaaauguuaaauaugcugugcgcuugaggaacuauggaagccguacagccaauggagauggaggaaugaccacaguucagugcccugauggugugacauucacauucagcacgugcagcuugagcaguaacggcacaaaccaaaccagaggacagaucccacagauacucuacuauaggagugaauuugauggagauuuacaaucccaacuucugaguaaagccaaugaagaagauaaaaacuguagcagagcauugucuguuguaagcacugucguucgagccucuaaggaccuccugcacagagcucuugcuguggaugcugaugacauuccagaacugcugaguucuuccagucuguuuuccaugcugcucccccuuauuauagccuacauaggaccaguagcugcugcuauucccaagguggcuguagaagucuuuggccuuguccaacaauugcuuccgucaguugccauuuugaaucagaaguaugcaccgccugccuucaacccuaaucagucgacagauagcaccacaggaaaccagccugaacagggccucucugcuuguacaaccuccagucacuaugcugucauagagagugagcacccguauaaaccugccugugugaugcauuacaaggugacauucccagaaugugugagguggaugacaaucgaauuugacccucagugugguacugcacagucagaagauguccuucguuuguugauuccugucagaacuguucagaauucaggauauggaccaaaauugacaucuguucaugaaaaucuuaauucauggauagaauuaaagaaauuuucaggauccucuggguggccuacuaugguuuugguguugccaggaaaugaggcccuuuuuucauuggagacugcaucagauuaugugaaagaugacaaagcuucuuucuaugguuuuaaguguuuugcaauuggauaugaauuuagcccuggaccugaugagggagucauccaauuggaaaaagaauuagccaaucuuggugggguuugugcagcagcucugaugaagaaggaccuagcacuuccuauugguaaugaauuagaagaagaccuugaaauucuugaggaggcugcauugcaggugugcaaaacccauucuggaauucuuggaaagggucuagcucuuucucauucaccaacuauauuagaagcacuugagggaaauuuaccacuccaaauccaaagcaaugaacagucuuuucuggaugauuuuauugccugugucccaggaucaagugguggaaggcuugcaagguggcuucagccagauucauaugcggauccucagaaaacaucuuugauccugaauaaggaugauauucguugugguuggccuaccaccauaacuguucaaacaaaagaccaguauggggaugugguacauguucccaauaugaagguggaagugaaagcugucccuguuucucagaaaaaaaugucuuuacaacaagaucaagcaaagaaaccucaaaggauuccuggcaguccugcaguaacagcugcaucuucuaauacugacaugacuuauggagggcuggcaucaccaaagcuagauguuucauaugaaccaaugauagugaaggaagcucgauauauugccauaacaaugaugaagguuuaugaaaauuauucauuugaagaacuacguuuugcaucaccaacuccuaagagacccagugagaauaugcugauccgugucaauaaugaugggacuuauugugcaaauuggacuccaggggcuauuggacucuacacucuucauguuaccauugauggcauugaaaucgaugcuggucuggaaguaaaaguaaaagacccaccaaaagggaugauaccaccaggaacucaguuggucaaaccaaagucugaaccucagccuaauaagguucgaaaauuuguggccaaggacagugcggggcuucgcauccguagccacccuucccuucagagugagcagauaggcauagugaaagucaauggaacuaucacuuuuauugaugagauccauaaugaugaugguguguggcugaggcugaaugaugagacaauaaagaaguaugucccuaacaugaaugguuacacugaagccuggugccucucuuuuaaucaacaucuuggcaagagucuucuggucccuguugacgaaucuaaaacuaauacugaugacuuuuucaaagacauaaacuccugcugcccacaggaagcaacaaugcaagaacaagauaugccauucuugcgaggagggccaggcauguacaagguagugaagacgggaccuucaggucacaacaucagaagcugcccuaaccuuagagguaucccaauuggaauguuaguucugggaaacaaagucaaagcagugggagagguaaccaauucugaagggacaugggugcaacuggaucagaacagcaugguagaguucugugagagugaugaaggagaggcaugguccuuagcuagagacagaggcggaaaccaguaccuccgacaugaagaugaacaagcucuucuggaucagaauucucaaacuccuccuccaagcccuuucucagugcaagcuuuuaauaaaggggcaaguugcagugcccaaggauuugauuauggacucggaaauagcaaaggugaucgaggaaacaucucaacaucuucuaaaccagccucuacaucaggaaaaucagagcuguccucuaaacacagcagaucgcuuaaaccugauggacguaugagccggacuacugcugaucagaagaagccaaggggcacagaaaguuuaucugcuagugaaucccucaucuuaaaaucugaugcugcaaaguugaggucagauucccacaguaggucauuaucccccaaccauaacaccuugcagacauugaaaucugaugggaggaugccuucuagcuccagagcugaauccccaggaccagguucucgguugucaucuccuaagccaaagacucucccagccaauaggucuagcccaucgggugcuaguucuccacgcuccuccucaccacaugauaaaaaucuaccucaaaaaaguacugcuccuguuaagacaaagcuugauccuccucgggaacguucuaaaucagacucuuacacacuugauccagauacccuccgcaagaagaaaaugccccucacagaaccuuugagaggacggucaacgucaccaaaaccaaaaucaguaccaaaggauucuacagauuccccuggaucugaaaauagagcucccucuccccaugugguacaggaaaaccuccacagugagguggucgaagucugcaccucaaguacuuuaaaaacaaauagucuaacagacagcaccugcgaugacagcagugaauuuaagaguguggaugaagguucaaauaaaguucauuuuagcauuggaaaagcaccacugaaagaugaacaggaaaugagagcaucucccaaaauaagucgaaaaugugcuaauagacacaccaggcccaaaaaagaaaaaucgaguuuucuuuucaaaggagauggauccaagccuuuagagccagccaagcaagccaugucuccuucuguggccgaaugugccagagcuguguuugcuuccuuccucuggcaugaaggcauaguacaugaugcaauggcuuguucuucuuuccuaaaguuucauccugaacuuuccaaagaacaugcuccuauaaggaguaguuuaaauagccaacaaccuacagaggaaaaagaaaccaaguuaaaaaauagacauucauuagaaauaucaucugcacugaauauguuuaauauugcaccccauggaccagauauaucuaagauggguagcaucaacaaaaacaagguauugucuaugcuuaaggaaccaccucugcaugaaaaaugugaggaugggaaaaccgagaccacuuuugaaauguccaugcauaacacaaugaagucuaagucuccucuucccuuaacuuuacaacauuuaguggcuuuuugggaagacaucucuuuggcuacuaucaaagcugcuucccagaauaugauuuuuccaaguccugguuccugugcaguucuuaaaaagaaagagugugagaaagagaauaagaaguccaaaaaggaaaaaaagaaaaaagaaaaggcagaaguuaggcccagggguaauuuguuuggagagauggcccagcuggcaguaggaggaccagagaaagauaccaucugugaacuguguggggagucacauccauacccggugaccuaucacaugagacaagcucacccagguuguggccgauaugcugguggacaagguuacaauagcauugggcauuuuuguggaggaugggcugguaacuguggugaugguggcauaggaggaagcacuugguaucugguaugugaucgcuguagagaaaaauaccuccgcgaaaaacaggcugcugcaagggagaaggucaaacaaucuaggagaaaaccaaugcaagucaagaccccucgugccuugcccaccauggaagcucaccaggugauuaaagccaaugcacucuuccugcugucccugagcagugcagcagaaccgagcauucuguguuaccauccugcaaagccauuccaaucucaguugcccaguguaaaagaaggcauuucugaggaucuuccugugaaaaugccuugucucuaccugcagacauuagcuaggcaucaucaugaaaauuuugugggcuaucaagaugacaaucuauuccaggaugaaaugagauaucuacguucaacaucuguaccugccccguauauaucaguaacuccugaugcaaguccuaauguauuugaagagccagagagcaauaugaagucuaugccaccaaguuuagaaaccagucccauaacugauacugaucuugcaaagagaacugucuuccaaagaucauacucaguuguugcuuccgaauaugauaaacaacacuccauuuuaccugcacgaguuaaagcuauuccuagaagaagaguuaacaguggagacacugaaguugguucuucccuuuugagacauccgucuccugagcuuucucggcuaaucucagcccacagcucucuuucuaaaggagaacgaaauuuccaguggccaguuuuagcuuuuguuauacaacaucaugaucuagaaggucuugaaauagcaaugaaacaggcccuaaggaaaucugcuugucgaguuuuugcuauggaggcuuucaacuggcuucuguguaaugucauccaaaccacuucucuccaugauauucuguggcauuuuguggcaucacugacuccugcaccaguggaaccagaggaagaagaggaugaagaaaauaaaacaagcaaagaaaauucagaacaagagaaagauacaagaguaugugaacauccacucucagacauagugauugccggggaagcugcucauccuuuaccacacaccuuucaccgcuugcugcagaccaucucagaccuuaugaugucucuccccagcggcaguucauuacagcaaauggcccugaggugcuggagucucaaauucaagcaaucugaucaccaguuccuucaucagagcaacgucuuucaucacauuaacaauauuuugucaaagucagaugauggcgauagugaagagaguuuuagcaucaguauacagucuggcuuugaagcuaugagucaggaauuaugcauaguaaugugcuuaaaggacuuaaccagcauuguugacauaaaaacuucaagccgaccugccaugauuggcaguuugacagacggcuccacagaaaccuuuugggaaucaggagaugaagauaaaaacaaaacuaagaacaucaccaucaacuguguaaaaggaaucaaugcccgcuaugugucuguucacguggacaauucccgagaucuugggaauaaaguuaccucaaugaccuucuuaacuggcaaagcaguagaagauuugugcagaauaaagcagguugaucuggauuccaggcacauuggcuggguaacaagugaacuuccaggaggggauaaucacaucauaaaaauugaauuaaaaggcccagaaaauacacugagaguucgacaagucaaaguccugggcuggaaagauggugaaagcacaaaaauagcuggccagauuucagccaguguggcccagcagaggaacugugaagcugagacucugcgaguauucagacugauuacgucucaaguauuuggaaagcucaucucuggagaugcugaaccuacaccagaacaagaggaaaaagcacuauugucaucaccugaaggagaagaaaaaguauacaaugcaacaucagaugcugaccugaaagaacauaugguuggaaucauauucagcaggaguaagcugacuaacuuacaaaaacaggugugugcucauauuguccaagcuauucgcauggaagcuaccagaguccgugaagaaugggaacaugcuauaucaagcaaagaaaaugccaauucucagccaaaugaugaagaugccuccucugaugccuacugcuuugagcugcucucuaugguuuuagcacugaguggcucuaacguuggccggcaauaucuggcucaacagcuaacccugcuucaggaucucuucucgcugcuucacacagccucuccuagaguccagagacagguaaccucuuuacuaagaagaguuuugccugaaguaaccccuagucgucuggccagcaucauaggagugaaaucccuccccccagcagauaucagugauaucauucacucaacagagaaaggagacuggaauaagcuggguaucuuggacauguuucuaggaugcauugccaaagcacucacuguacagcuaaaagccaaaggaaccaccaucacuggaacagcugguaccacugugggcaaaggaguuacaacaguuacucuuccgaugauuuucaauuccaguuaucuccgacgaggugaaagucauugguggaugaagggcucaaccccuacccagaucucagagaucaucauuaaacuuaucaaggauauggcagcaggucaucugucagaagcuuggucccgagugacaaaaaaugcuauugcagaaaccaucauugccuugaccaagauggaagaagaauuuaggucuccagugagauguauugcaacaacuagacucuggcuugcucucgcaucccuauguguucuugaucaggaccacguagaucgucucuccucggggagauggaugggaaaggauggacaacaaaaacaaaugccuaugugugauaaccaugaugauggugaaacugcagcaaucauuuuaugcaaugucuguggaaauuuauguacagacugugacagauuccuucaccuucaucgaagaaccaaaacucaucaaagacaggucuucaaagaagaagaagaagcuauaaagguugaccuucaugaagguugugguagaaccaaauuguucugguugauggcacuggcagauucuaaaacaaugaaggcaaugguggaauuccgagaacacacaggcaaacccaccacgaguagcucagaagcaugucgcuucugugguuccaggaguggaacagaguuaucugcuguuggcaguguuuguucugaugcagauugccaggaauacgcuaagauagccuguaguaagacgcauccuuguggccauccaugcggggguguuaaaaacgaagagcacugucugcccugucuacacggcugugacaaaagugccacaagccugaagcaagacgccgaugacaugugcaugauauguuucaccgaagcgcucucggcagcaccagccauucagcuggauuguagucacauauuccacuuacagugcugucggcgaguauuagaaaaucgauggcuuggcccaaggauaacauuuggauuuauaucuugucccauuugcaagaacaaaauuaaucacauaguacuaaaagaccuacuugauccaauaaaagaacucuaugaggaugucagaagaaaagccuuaaugagauuggaauaugaaggucugcauaagagugaagcuaucacaacuccuggugugagguuuuauaaugacccagcuggcuaugcaaugaauagauaugcauauuaugugugcuacaaaugcagaaaggcauauuuugguggugaagcucgcugcgaugcugaggcuggacggggagaugauuaugaucccagagagcucauuuguggugccuguucugauguuuccagggcucagaugugucccaaacauggcacagacuuuuuggaauauaaaugucgcuacugcuguucaguggcuguuuuuuucuguuuuggaacaacacauuuuuguaaugcuugucaugaugauuuucaaagaaugacuagcauuccuaaggaagaacuaccacacuguccugcaggucccaaaggcaagcaguuagaaggaacugaauguccacuccauguuguucauccacccacuggggaagaguuugcucugggauguggagugugcagaaaugcccacacuuuuuagaacacgcagauccuuugucuacagagagaaaaauugccuucaucccccaagaggaugcggugaaguuuaaacucugcucaggauaaggacgggaccauuuuuacauccaugaaaaugaaccauucacagugcaagaaggauaccaaauaccauguacauaauucuugcuaugaaaaguuuccccauuauuuugguuuaucuucuuuugaacaaaugacaucaaacuugugagguguuugcauguggccauuaccgucauuggccugugaagcauuggacauuuauagauaauugauauaaaagaaucgccaugcccauggacuaagaacgaugcuggcuuucaagcaaaaaagaaaaauaaucauuguuuauuguauacugccuuuuuguaauccuguacaauugcaucacggguggggauaaaaagaggaauauucugguuuauuuccuagacuguuauuuaaaaaaaaaaaaaacauuguguuaggacagcauauaaauguaauaaguaucacacuguauauaaacauaucaauguuuguccuguauaagaauuacuaaauuacaaaugcaauuucauuuaaacuucuagguuaaguuugagccugaaauuuuaaugaagugcaauacugagugugccucauuaucuugcagcuguaaacauauuggaauguacaugucaauaaaaccacuguacauuuuuauacagugauaaagucua

SEQ ID NO: 230 - RNA, 2612 nt, Homo_Sapiens
cagcagccagggccgccucuuaaagggagguggccggccuuaaaggacccccgcgcgcccagccggcgggagcgcggcggcccggcucccgcagggccgcgccgaggcaggcgagcccccgcggcgcccaggcgcgggcccgggcccccgccgccgccgccgccgccgggcgcggcauuuuuauucaggcgacgcuuaagggagcccggccgcgcccggugcauugugggagcggcccgcggcccguuuucgggaggaggcggagggcgcaaagcgagccgguggauccauaaagaacccagccaacccgcagagggaggggaggggcugagcugugaggagagcggggcccaagaaccaugucuacgcgggaguccuuuaacccggaaaguuacgaauuggacaaaagcuuccggcuaaccagauucacugaacugaagggcacaggcugcaaagugccccaagauguccugcaaaaauugcuggaaucuuuacaggagaaccacuuccaagaagaugagcaguuucugggagccguuaugccaaggcuuggcauuggaauggauacuugugucauuccuuugaggcacggugggcuuuccuugguucaaaccacagauuacauuuacccgaucguagacgacccuuacaugaugggcaggauagcgugugccaauguccucagugaccucuaugcaaugggggucacggaaugugacaauaugcugaugcuccuuggagucaguaauaaaaugaccgacagggaaagggauaaagugaugccucugauuauccaagguuuuaaagacgcagcugaggaagcaggaacgucuguaacaggcggccaaacaguacuaaaccccuggauuguccugggaggaguggcuaccacugucugccaacccaaugaauuuaucaugccagacaaugcagugccaggggacgugcuggugcugacaaaaccccuggggacacagguggcaguggcugugcaccaguggcuggauaucccugagaaauggaauaagauuaaacuaguggucacccaagaagauguagagcuggccuaccaggaggcgaugaugaacauggcgaggcucaacaggacagcugcaggacucaugcacacguucaaugcccacgccgccacugacaucacgggcuucgggauuuugggccaugcgcagaaccuggccaagcagcagaggaacgaggugucguuuguaauucacaaccucccggugcuggccaagauggcugcggugagcaaggccugcggaaacauguucggccucaugcacgggaccugcccggagacuucaggcggccuucugaucuguuuaccacgugagcaagcagcucgguucugugcagagauaaagucccccaaauauggugaaggccaccaagcauggauuauugggauuguagagaagggcaaccgcacagccagaaucauagacaaaccccggaucaucgaggucgcaccacaaguggccacucaaaaugugaaucccacacccggggccaccucuuaaucuagacagaaauagcuguuugguuuuguuuuuaaauagaucuauuucccuuaucacuucaauuaaagacuauaaacaacaaaaaucucauugugucuacacaucggggugaccuuaggucgguuuguaaguggauacaauuaauaaaauaaaauccauugccuuuuuuuccuguuacauuaacugaagaugcaccuaaucuugaggcagcuucugaguugagaauuauauuguuauccaauacuguugauucauuuugaaucuuuagacacuuaucucuugccgcauaggcuuuuuaaaggugcuuucacauagcacaggcauuacccguagucgugucaaauagcaguuggugucuucauuuuauguauauuuaucauauaagucugauuuuuuuuuuuaagcgucuugaaugguuuucuggagagacagcauugguaaguggcacaugacgguaucccagucauaagaggguugcaugauuccuuugaguguuugauuugaaaagccuagucuugucucucaagagcaucucggacccagaacauucuccaguagugcauucaguucaacacagcaagugcuucauugcauggaaaacacuuugaagacaaaaaagaaaucuuauuucuuuuuuuguagccuuccugauauuuacaguaauaccauuaacuguuuuaucgauagcaaaaaaggauacuuuuugcaauguuauuagauguucuauagugcuacaaggaauugccuuccgaauggagguucauguauaauacucauuuacaauucaauauauaauuacacaaauaauuuuuaaauauaaucaauaguaaagacuguucuguggaugguaguguuuaauacauuuucuauuuuguacagugauuucaggccuuuuguuuucuuaaaaucagcagcuguuuggccuaauucuuagcauuauuuuguccuuugcgccaguacuuuuuugugcacgcuuuuugugaucuguguuaaaaaccugcauugccaacauugcagcucgaacuuaaacuuguuauucaaauaaauauuuaauuuuuuaaaaaaaaaaaaaaa

SEQ ID NO: 231 - RNA, 3428 nt, Homo_Sapiens
uggagaguaauguuacagagcggagagagugaggaggcugcgucuggcucccgcucucacagccauugcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaagcggacaaggcccguuaugaaagagaaaugaaaaccuauaucccucccaaaggggagacaaaaaagaaguucaaggaucccaaugcacccaagaggccuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaugaagaagaagaugaugaugaugaauaaguugguucuagcgcaguuuuuuuuuucuugucuauaaagcauuuaaccccccuguacacaacucacuccuuuuaaagaaaaaaauugaaauguaaggcuguguaagauuuguuuuuaaacuguacagugucuuuuuuuguauaguuaacacacuaccgaaugugucuuuagauagcccuguccuggugguauuuucaauagccacuaaccuugccugguacaguauggggguuguaaauuggcauggaaauuuaaagcagguucuuguuggugcacagcacaaauuaguuauauauggggaugguaguuuuuucaucuucaguugucucugaugcagcuuauacgaaauaauuguuguucuguuaacugaauaccacucuguaauugcaaaaaaaaaaaaaaaguugcagcuguuuuguugacauucugaaugcuucuaaguaaauacaauuuuuuuuauuaguauuguuguccuuuucauaggucugaaauuuuucuucuugaggggaagcuagucuuuugcuuuugcccauuuugaaucacaugaauuauuacaguguuuauccuuucauauaguuagcuaauaaaaagcuuuugucuacacacccugcauaucauaauggggguaaaguuaaguugagauaguuuucauccauaacugaacauccaaaaucuugaucaguuaagaaauuucacauagcccacuuacauuuacaaacugaagaguaaucaaucuacucaaagcaugggauuauuagaaucaaacauuuugaaagucuguccuugaaggacuaauagaaaaguauguucuaaccuuuacaugaggacucuauucuuuaacucccauuaccauguaauggcaguuauauuuugcaguucccacauuaaagaagaccugagaauguauccccaaaagcgugagcuuaaaauacaagacugccauauuaaauuuuuuguugacauuagucucagugaagacuaugaaaaugcuggcuauagaugucuuuucccauuuaucuaaauauggacugcucaggaaacgagacuuuccauuacaaguauuuuuaauuaauugggccagcuuuucaaacaaagaugccacauucaaaauaggguauauuuuccuauauuacgguuugccccuuuauaaauccaaguagauaggaagaaagaagacaaacuuugcaucucaguaugaauuauucaauuuauuugaaugauuuuucuuuacaaaacaaacucauucauuagucauguuuaucugcuuaggaguuuagggaacaauuuggcaauuuugugguuuucgagauuaucguuuucuuaaagugccaguauuuuaaaauagcguucuuguaauuuuacacgcuuuugugauggagugcuguuuuguuauauaauuuagacuuggauucuuuccauuugcauuuguuuauguaauuucaggaggaauacugaacaucugaguccuggaugauacuaauaaacuaauaauugcagagguuuuaaauacuaguuaaauggcuuucacuuaagaacuuaagauuuuguuacauauuuuuaaaucuuguuucuaauaauaccucuuagcaguaccuuuuaaauaaguauaagggauggcaaaguuuuucccuuuaaaaauacucacuuuaugcuuauaaauagguuaaugggcugauaaaagguuuugucaaacauugcaaguauucggugcuauauauaaaggaggaaaaacuaguuuuacuuucagaaugauuuaaacaagauuuuuaaaaacaagauacaugcaagcgaacagcaggguuagugauaggcugcaauugugucgaacaucagauuuuuuguuaagaggagcaaaugacucaaucugauuuagauggaaguuucuacuguauagaaaucaccauuaaucaccaacauuaauaauucugauccauuuaaaaugaauucuggcucaaggagaauuuguaacuuuaguagguacgucaugacaacuaccauuuuuuuaagauguugagaaugggaacaguuuuuuuaggguuuauucuugaccacagaucuuaagaaaauggacaaaaccccucuucaaucugaagauuaguaugguuugguguucuaacaguauccccuagaaguuggaugucuaaaacucaaguaaauggaagugggaggcaauuuagauaaguguaaagccuuguaacugaagaugauuuuuuuuagaaaguguauagaaacuauuuuaaugccaagauaguuacagugcugugggguuuaaagacuuuguugacaucaagaaaagacuaaaucuauaauuaauugggccaacuuuuaaaaugaagaugcuuuuuaaaacuaaugaacuaagauguauaaaucuuaguuuuuuuguauuuuaaagauaggcauauggcauauugauuaacgagucaaauuuccuaacuuugcugugcaaagguugagagcuauugcugauuaguuaccacaguucugaugaucgucccaucacaguguuguuaauguuugcuguauuuauuaauuuucuuaaagugaaaucugaaaaaugaaauuuguguguccuguguacccgagggguaaugauuaaaugauaaagauaagaaaa

SEQ ID NO: 232 - RNA, 1527 nt, Homo_Sapiens
ggggauguggcccguggccuagcucgucaaguugccguggcgcggagaacucugcaaaacaagaggcugaggauugcguuagagauaaaccaguucacgccggagccccgugagggaagcgucuccguuggguccggccgcucugcgggacucugaggaaaagcucgcaccagguggacgcggaucugucaacauggguaaaggagaccccaacaagccgcggggcaaaauguccucguacgccuucuucgugcagaccugccgggaagagcacaagaagaaacacccggacucuuccgucaauuucgcggaauucuccaagaaguguucggagagauggaagaccaugucugcaaaggagaagucgaaguuugaagauauggcaaaaagugacaaagcucgcuaugacagggagaugaaaaauuacguuccucccaaaggugauaagaaggggaagaaaaaggaccccaaugcuccuaaaaggccaccaucugccuucuuccuguuuugcucugaacaucgcccaaagaucaaaagugaacacccuggccuauccauuggggauacugcaaagaaauugggugaaauguggucugagcagucagccaaagauaaacaaccauaugaacagaaagcagcuaagcuaaaggagaaauaugaaaaggauauugcugcauaucgugccaagggcaaaagugaagcaggaaagaagggcccuggcaggccaacaggcucaaagaagaagaacgaaccagaagaugaggaggaggaggaggaagaagaagaugaagaugaggaggaagaggaugaagaugaagaauaaauggcuauccuuuaaugaugcguguggaaugugugugugugcucaggcaauuauuuugcuaagaaugugaauucaagugcagcucaauacuagcuucaguauaaaaacuguacagauuuuuguauagcugauaagauucucuguagagaaaauacuuuuaaaaaaugcagguuguagcuuuuugaugggcuacucauacaguuagauuuuacagcuucugauguugaauguuccuaaauauuuaaugguuuuuuuaauuucuuguguaugguagcacagcaaacuuguaggaauuaguaucaauaguaaauuuuggguuuuuuaggauguugcauuucguuuuuuuaaaaaaaauuuuguaauaaaauuauguauauuauuucuauugucuuugucuuaauaugcuaaguuaauuuucacuuuaaaaaagccauuugaagaccagagcuauguugauuuuuuucgguauuucugccuaguaguucuuagacacaguugaccuaguaaaauguuugagaauuaaaaccaaacaugcucauauuugcaaaauguucuuuaaaaguuacauguugaacucagugaacuuuauaagaauuuaugcaguuuuacagaacguuaaguuuuguacuugacguuucuguuuauuagcuaaauuguuccucagguguguguauauauauauacauauauauauauauauauau

SEQ ID NO: 233 - RNA, 1467 nt, Homo_Sapiens
aaaccaguucacgccggagccccgugagggaagcgucuccguuggguccggccgcucugcgggacucugaggaaaagcucgcaccaggcaagaauacccuccaauacccucggguggacgcggaucugucaacauggguaaaggagaccccaacaagccgcggggcaaaauguccucguacgccuucuucgugcagaccugccgggaagagcacaagaagaaacacccggacucuuccgucaauuucgcggaauucuccaagaaguguucggagagauggaagaccaugucugcaaaggagaagucgaaguuugaagauauggcaaaaagugacaaagcucgcuaugacagggagaugaaaaauuacguuccucccaaaggugauaagaaggggaagaaaaaggaccccaaugcuccuaaaaggccaccaucugccuucuuccuguuuugcucugaacaucgcccaaagaucaaaagugaacacccuggccuauccauuggggauacugcaaagaaauugggugaaauguggucugagcagucagccaaagauaaacaaccauaugaacagaaagcagcuaagcuaaaggagaaauaugaaaaggauauugcugcauaucgugccaagggcaaaagugaagcaggaaagaagggcccuggcaggccaacaggcucaaagaagaagaacgaaccagaagaugaggaggaggaggaggaagaagaagaugaagaugaggaggaagaggaugaagaugaagaauaaauggcuauccuuuaaugaugcguguggaaugugugugugugcucaggcaauuauuuugcuaagaaugugaauucaagugcagcucaauacuagcuucaguauaaaaacuguacagauuuuuguauagcugauaagauucucuguagagaaaauacuuuuaaaaaaugcagguuguagcuuuuugaugggcuacucauacaguuagauuuuacagcuucugauguugaauguuccuaaauauuuaaugguuuuuuuaauuucuuguguaugguagcacagcaaacuuguaggaauuaguaucaauaguaaauuuuggguuuuuuaggauguugcauuucguuuuuuuaaaaaaaauuuuguaauaaaauuauguauauuauuucuauugucuuugucuuaauaugcuaaguuaauuuucacuuuaaaaaagccauuugaagaccagagcuauguugauuuuuuucgguauuucugccuaguaguucuuagacacaguugaccuaguaaaauguuugagaauuaaaaccaaacaugcucauauuugcaaaauguucuuuaaaaguuacauguugaacucagugaacuuuauaagaauuuaugcaguuuuacagaacguuaaguuuuguacuugacguuucuguuuauuagcuaaauuguuccucagguguguguauauauauauacauauauauauauauauauau

SEQ ID NO: 234 - RNA, 1454 nt, Homo_Sapiens
ggauuugggcgggaagcggagccccgccagcgcccgcccuggcagcugcgggcuccgcgccgacccuccggcuuccccucuccccccucggccccgucagguggacgcggaucugucaacauggguaaaggagaccccaacaagccgcggggcaaaauguccucguacgccuucuucgugcagaccugccgggaagagcacaagaagaaacacccggacucuuccgucaauuucgcggaauucuccaagaaguguucggagagauggaagaccaugucugcaaaggagaagucgaaguuugaagauauggcaaaaagugacaaagcucgcuaugacagggagaugaaaaauuacguuccucccaaaggugauaagaaggggaagaaaaaggaccccaaugcuccuaaaaggccaccaucugccuucuuccuguuuugcucugaacaucgcccaaagaucaaaagugaacacccuggccuauccauuggggauacugcaaagaaauugggugaaauguggucugagcagucagccaaagauaaacaaccauaugaacagaaagcagcuaagcuaaaggagaaauaugaaaaggauauugcugcauaucgugccaagggcaaaagugaagcaggaaagaagggcccuggcaggccaacaggcucaaagaagaagaacgaaccagaagaugaggaggaggaggaggaagaagaagaugaagaugaggaggaagaggaugaagaugaagaauaaauggcuauccuuuaaugaugcguguggaaugugugugugugcucaggcaauuauuuugcuaagaaugugaauucaagugcagcucaauacuagcuucaguauaaaaacuguacagauuuuuguauagcugauaagauucucuguagagaaaauacuuuuaaaaaaugcagguuguagcuuuuugaugggcuacucauacaguuagauuuuacagcuucugauguugaauguuccuaaauauuuaaugguuuuuuuaauuucuuguguaugguagcacagcaaacuuguaggaauuaguaucaauaguaaauuuuggguuuuuuaggauguugcauuucguuuuuuuaaaaaaaauuuuguaauaaaauuauguauauuauuucuauugucuuugucuuaauaugcuaaguuaauuuucacuuuaaaaaagccauuugaagaccagagcuauguugauuuuuuucgguauuucugccuaguaguucuuagacacaguugaccuaguaaaauguuugagaauuaaaaccaaacaugcucauauuugcaaaauguucuuuaaaaguuacauguugaacucagugaacuuuauaagaauuuaugcaguuuuacagaacguuaaguuuuguacuugacguuucuguuuauuagcuaaauuguuccucagguguguguauauauauauacauauauauauauauauauau

SEQ ID NO: 235 - RNA, 7255 nt, Homo_Sapiens
guccccagccccgucgccggcggaggcgggcgcgggcgcgucccuguggccagucacccggaggaguuggucgcacaauuaugaaagacucggcuucugcugcuagcgccggagcugaguuaguucugagaagguuucccugggcguuccuuguccggcggccucugcugccgccuccggagacgcuucccgauagauggcuacaggccgcggaggaggaggagguggaguugcugcccuuccggaguccgccccgugaggagaaugucccagaaauccuggauagaaagcacuuugaccaagagggaauguguauauauuauaccaaguuccaaggacccucacagaugccuuccaggaugucaaauuugucagcaacucgucagguguuuuuguggucgcuuggucaagcaacaugcuuguuuuacugcaagucuugccaugaaauacucagaugugaaauugggugaccauuuuaaucaggcaauagaagaauggucuguggaaaagcauacagaacagagcccaacggaugcuuauggagucauaaauuuucaaggggguucucauuccuacagagcuaaguaugugaggcuaucauaugacaccaaaccugaagucauucugcaacuucugcuuaaagaauggcaaauggaguuacccaaacuuguuaucucuguacaugggggcaugcagaaauuugagcuucacccacgaaucaagcaguugcuuggaaaaggucuuauuaaagcugcaguuacaacuggagccuggauuuuaacuggaggaguaaacacagguguggcaaaacauguuggagaugcccucaaagaacaugcuuccagaucaucucgaaagauuugcacuaucggaauagcuccauggggagugauugaaaacagaaaugaucuuguugggagagaugugguugcuccuuaucaaaccuuauugaacccccugagcaaauugaauguuuugaauaaucugcauucccauuucauauugguggaugauggcacuguuggaaaguauggggcggaagucagacugagaagagaacuugaaaaaacuauuaaucagcaaagaauucaugcuaggauuggccagggugucccugugguggcacuuauauuugagggugggccaaauguuauccucacaguucuugaauaccuucaggaaagccccccuguuccaguaguugugugugaaggaacaggcagagcugcagaucugcuagcguauauucauaaacaaacagaagaaggagggaaucuuccugaugcagcagagcccgauauuauuuccacuaucaaaaaaacauuuaacuuuggccagaaugaagcacuucauuuauuucaaacacugauggagugcaugaaaagaaaggagcuuaucacuguuuuccauauugggucagaugaacaucaagauauagauguagcaauacuuacugcacugcuaaaagguacuaaugcaucugcauuugaccagcuuauccuuacauuggcaugggauagaguugacauugccaaaaaucauguauuuguuuauggacagcaguggcugguuggauccuuggaacaagcuaugcuugaugcucuuguaauggauagaguugcauuuguaaaacuucuuauugaaaauggaguaagcaugcauaaauuccuuaccauuccgagacuggaagaacuuuacaacacuaaacaagguccaacuaauccaaugcuguuucaucuuguucgagacgucaaacagggaaaucuuccuccaggauauaagaucacucugauugauauaggacuuguuauugaauaucucaugggaggaaccuacagaugcaccuauacuaggaaacguuuucgauuaauauauaauagucuugguggaaauaaucggaggucuggccgaaauaccuccagcagcacuccucaguugcgaaagagucaugaaucuuuuggcaauagggcagauaaaaaggaaaaaaugaggcauaaccauuucauuaagacagcacagcccuaccgaccaaagauugauacaguuauggaagaaggaaagaagaaaagaaccaaagaugaaauuguagacauugaugauccagaaaccaagcgcuuuccuuauccacuuaaugaacuuuuaauuugggcuugccuuaugaagaggcaggucauggcccguuuuuuauggcaacauggugaagaaucaauggcuaaagcauuaguugccuguaagaucuaucguucaauggcauaugaagcaaagcagagugaccugguagaugauacuucagaagaacuaaaacaguauuccaaugauuuuggucaguuggccguugaauuauuagaacaguccuucagacaagaugaaaccauggcuaugaaauugcucacuuaugaacugaagaacuggaguaauucaaccugccuuaaguuagcaguuucuucaagacuuagaccuuuuguagcucacaccuguacacaaauguuguuaucugauauguggaugggaaggcugaauaugaggaaaaauuccugguacaaggucauacuaagcauuuuaguuccaccugccauauugcuguuagaguauaaaacuaaggcugaaaugucccauaucccacaaucucaagaugcucaucagaugacaauggaugacagcgaaaacaacuuucagaacauaacagaagagauccccauggaaguguuuaaagaaguacggauuuuggauaguaaugaaggaaagaaugagauggagauacaaaugaaaucaaaaaagcuuccaauuacgcgaaaguuuuaugccuuuuaucaugcaccaauuguaaaauucugguuuaacacguuggcauauuuaggauuucugaugcuuuauacauuugugguucuuguacaaauggaacaguuaccuucaguucaagaauggauuguuauugcuuauauuuuuacuuaugccauugagaaaguccgugagaucuuuaugucugaagcugggaaaguaaaccagaagauuaaaguaugguuuagugauuacuucaacaucagugauacaauugccauaauuucuuucuucauuggauuuggacuaagauuuggagcaaaauggaacuuugcaaaugcauaugauaaucauguuuuuguggcuggaagauuaauuuacugucuuaacauaauauuuugguaugugcguuugcuagauuuucuagcuguaaaucaacaggcaggaccuuauguaaugaugauuggaaaaaugguggccaauauguucuacauuguagugauuauggcucuuguauuacuuaguuuugguguucccagaaaggcaauacuuuauccucaugaagcaccaucuuggacucuugcuaaagauauaguuuuucacccauacuggaugauuuuuggugaaguuuaugcauacgaaauugaugugugugcaaaugauucuguuaucccucaaaucugugguccugggacgugguugacuccauuucuucaagcagucuaccucuuuguacaguauaucauuaugguuaaucuucuuauugcauuuuucaacaauguguauuuacaagugaaggcaauuuccaauauuguauggaaguaccagcguuaucauuuuauuauggcuuaucaugagaaaccaguucugccuccuccacuuaucauucuuagccauauaguuucucuguuuugcugcauauguaagagaagaaagaaagauaagacuuccgauggaccaaaacuuuucuuaacagaagaagaucaaaagaaacuucaugauuuugaagagcaguguguugaaauguauuucaaugaaaaagaugacaaauuucauucugggagugaagagagaauucgugucacuuuugaaagaguggaacagaugugcauucagauuaaagaaguuggagaucgugucaacuacauaaaaagaucauuacaaucauuagauucucaaauuggccauuugcaagaucuuucagcccugacgguagauacauuaaaaacacucacugcccagaaagcgucggaagcuagcaaaguucauaaugaaaucacacgagaacugagcauuuccaaacacuuggcucaaaaccuuauugaugaugguccuguaagaccuucuguauggaaaaagcaugguguuguaaauacacuuagcuccucucuuccucaaggugaucuugaaaguaauaauccuuuucauuguaauauuuuaaugaaagaugacaaagauccccaguguaauauauuuggucaagacuuaccugcaguaccccagagaaaagaauuuaauuuuccagaggcugguuccucuucuggugccuuauucccaagugcuguuuccccuccagaacugcgacagagacuacaugggguagaacucuuaaaaauauuuaauaaaaaucaaaaauuaggcaguucaucuacuagcauaccacaucugucauccccaccaaccaaauuuuuuguuaguacaccaucucagccaaguugcaaaagccacuuggaaacuggaaccaaagaucaagaaacuguuugcucuaaagcuacagaaggagauaauacagaauuuggagcauuuguaggacacagagauagcauggauuuacagagguuuaaagaaacaucaaacaagauaaaaauacuauccaauaacaauacuucugaaaacacuuugaaacgagugaguucucuugcuggauuuacugacugucacagaacuuccauuccuguucauucaaaacaagcagaaaaaaucaguagaaggccaucuaccgaagacacucaugaaguagauuccaaagcagcuuuaauaccggauugguuacaagauagaccaucaaacagagaaaugccaucugaagaaggaacauuaaauggucucacuucuccauuuaagccagcuauggauacaaauuacuauuauucagcuguggaaagaaauaacuugaugagguuaucacagagcauuccauuuacaccugugccuccaagaggggagccugucacaguguaucguuuggaagagaguucacccaacauacuaaauaacagcaugucuucuuggucacaacuaggccucugugccaaaauagaguuuuuaagcaaagaggagaugggaggagguuuacgaagagcugucaaaguacaguguaccuggucagaacaugauauccucaaaucagggcaucuuuauauuaucaaaucuuuucuuccagaggugguuaauacauggucaaguauuuacaaagaagauacaguucugcaucucugucugagagaaauucaacaacagagagcagcacaaaagcuuacguuugccuuuaaucaaaugaaacccaaauccauaccauauucuccaagguuccuugaaguuuuccugcuguauugccauucagcaggacagugguuugcuguggaagaauguaugacuggagaauuuagaaaauacaacaauaauaauggagaugagauuauuccaacuaauacucuggaagagaucaugcuagccuuuagccacuggacuuacgaauauacaagaggggaguuacugguacuugauuugcaagguguuggugaaaauuugacugacccaucugugauaaaagcagaagaaaagagauccugugauaugguuuuuggcccagcaaaucuaggagaagaugcaauuaaaaacuucagagcaaaacaucacuguaauucuugcuguagaaagcuuaaacuuccagaucugaagaggaaugauuauacgccugauaaaauuauauuuccucaggaugagccuucagauuugaaucuucagccuggaaauuccaccaaagaaucagaaucaacuaauucuguucgucugauguuauaauauuaauauuacugaaucauugguuuugccugcaccucacagaaauguuacugugucacuuuucccucgggaggaaauuguuugguaauauagaaagguguaugcaaguugaauuugcugacuccagcacaguuaaaaggucaauauucuuuugaccugauuaaucagucagaaagucccuauaggauagagcuggcagcugagaaauuuuaaagguaauugauaauuaguauuuauaacuuuuuaaagggcucuuuguauagcagaggaucucauuugacuuuguuuugaugagggugaugcucucucuuaugugguacaauaccauuaaccaaagguagguguccaugcagauuuuauuggcagcuguuuuauugccauucaacuagggaaaugaagaaaucacgcagccuuuugguuaaauggcagucaaaauuuuccucaguguauuuaguguguucagugaugauaucacugguucccaacuagaugcuuguuggccacgggaagggaaaugacuuguucuaauucuagguucacagagguaugagaagccugaacugaagaccauuuucaagagggacgguauuuaugaaucaggguuaggcuccauauuuaaagauagagccaguuuuuuuuuuuaaauagaacccaaauuguguaaaaauguuaauuggguuuuuuaaacauuguuuuaucaagucacuguuaaguagaagaaagccaugguaaacugauacauaaccuaaauuauaaaagcagaaaccuaacucacucgucaagggaaguuaccuuuugaggaaaguuaaaguacuuuuuucccuaucuguaucuauagcaacaacccagaacuuacaaacuucuccaaagauuuuauugauuguuauaucaaaucagaauguaaacaugaacucuugcauauauuuaaaauuguguuggaacauuugaacaugaaugcuguuugugguacuuaagaaauuaauucaguuggauuaucauuaugugauacuggcagauugcagugcaaccuuaugccaauaaaauguaauuuaacagccccagauauuguugaauauucaacaauaacaagaaaagcuuuucaucuaaguuuuaugcuuuaauuuuuuuucuuuuuuuuucuuuuucuuuuguuuccuugguacuaauuuuaauuuuuauuuggaagggagcaguauaaagcuuauuuguauuuaguaguguaucucauagauacagacaaggcaagagaugauaagcuguuuaaauaguguuuaauauugauuggggguggggagaaagaaaaaguguauuacuuaaagauacuauauacguuuuguauaucauuaaaucuuuaaaagaaaugaaauaaauuuauuguuuacagaaaaaaaaa

SEQ ID NO: 236 - RNA, 2143 nt, Homo_Sapiens
ggaaguuuuccggcggcuaccgggaagucgcugaagacagagcgaugguaguucuggaggccucgcuccggggccgacccgaggccacagugccuccgcgguagaccggacuugggugacgggcuccgggcucccgaggugaagagcaucgggggcugagggauggaagggucuaagacguccaacaacagcaccaugcaggugagcuucgugugccagcgcugcagccagccccugaaacuggacacgaguuucaagauccuggaccgugucaccauccaggaacucacagcuccauuacuuaccacagcccaggcgaaaccaggagagacccaggaggaagagacuaacucaggagaggagccauuuauugaaacuccucgccaggauggugucucucgcagauucauccccccagccaggaugauguccacagaaagugccaacagcuucacucugauuggggaggcaucugauggcggcaccauggagaaccucagccgaagacugaaggucacuggggaccuuuuugacaucaugucgggccagacagauguggaucacccacucugugaggaaugcacagauacucuuuuagaccagcuggacacucagcucaacgucacugaaaaugagugucagaacuacaaacgcuguuuggagaucuuagagcaaaugaaugaggaugacagugaacaguuacagauggagcuaaaggagcuggcacuagaggaggagaggcugauccaggagcuggaagacguggaaaagaaccgcaagauaguggcagaaaaucucgagaagguccaggcugaggcugagagacuggaucaggaggaagcucaguaucagagagaauacagugaauuuaaacgacagcagcuggagcuggaugaugagcugaagaguguugaaaaccagaugcguuaugcccagacgcagcuggauaagcugaagaaaaccaacgucuuuaaugcaaccuuccacaucuggcacaguggacaguuuggcacaaucaauaacuucaggcugggucgccugcccaguguucccguggaauggaaugagauuaaugcugcuuggggccagacuguguugcugcuccaugcucuggccaauaagaugggucugaaauuucagagauaccgacuuguuccuuacggaaaccauucauaucuggagucucugacagacaaaucuaaggagcugccguuauacuguucugggggguugcgguuuuucugggacaacaaguuugaccaugcaaugguggcuuuccuggacugugugcagcaguucaaagaagagguugagaaaggcgagacacguuuuugucuucccuacaggauggauguggagaaaggcaagauugaagacacaggaggcaguggcggcuccuauuccaucaaaacccaguuuaacucugaggagcaguggacaaaagcucucaaguucaugcugacgaaucuuaaguggggucuugcuuggguguccucacaauuuuauaacaaaugacuuuuuuccuuagggggagguuugccuuaaaggcuuuuaauuuuguuuuguuugcaaacauguuuuaaauuaaauucggguaauauuaaacaguacauguuuacaauaccaaaaaagaaaaaauccacaaaagccacuuuauuuuaaaauaucaugugacagauacuuuccagagcuacaacaugccaucuauaguugccagcccuggucaguuuugauucuuaaccccauggacuccuuucccuuucuucucugaaaaaaacuaauuuaaauuugcuuuucuuuuuuuuaacugaguugaauugagauugauguguuuucacuggauuuuuaucucucucaacuuccugcacuuaacaauaugaaauagaaacuuuugucuuuacugagaugaggauauguuugagaugcacaguuggauaaugugggaaaaugacaucuaagcuuuaccuggucaccaugugaugugaucagaugcuugaaauuuaacacuuuucacuugguucuuauacugaaugccgacucugcucuguguuagagauaugaaaugguguuugauacuguuugagacauuauggagagauuuaauuauuuguaauaaaagauuugcugcagucugaaaacugcc

SEQ ID NO: 237 - RNA, 2224 nt, Homo_Sapiens
ccuacccggaccccgccggccucacaccccggccagccagccgccaguagugcgcaccgccuccuccccaagccccgcccugcguccaccccagggguuaacucgcacgcgcgcucuuguggcggagguagagugcgccguccagggcuagagcaagcgcggccccgcggcccggagccaugcugaggagcugcgccgcgcgccuccgcacgcugggggcucugugccugccgccaguaggccggcgccugccgggaagcgagccgcgacccgagcugaggucauuuucuucugaggaagucauucuuaaggacuguucuguccccaaccccagcuggaacaaggaccuaagacugcucuuugaccaguuuaugaagaaaugugaagacggcuccuggaaacguuugccuucauauaaacguacaccuacugaauggauucaagacuucaaaacccauuuucuugacccaaagcuuaugaaagaagaacaaaugucacaggcccagcucuucaccagaagcuuugaugauggccugggcuuugaauacgugauguucuacaaugacauugagaaaaggaugguuugcuuauuucaaggaggcccuuaccuggaaggaccaccuggauucauucauggaggugccauugcaaccaugauugaugcuacuguugguaugugugcaaugauggcugggggaaucgucaugacugccaaucucaacaucaauuauaaaagaccuaucccucuuuguucuguuguuaugauaaauagccaacuugauaaaguugaaggaaggaaauuuuuuguuuccuguaauguucagaguguugaugagaagacccuauacucagaggcgacaagcuuauuuauaaagcugaauccugcuaaaagucugacauaaagagcugcuggugaacuccaucucauucucgccccuccagaagaagcaguugucccccaaauacucugcucccucacugcugaaucccuguagggagaagccugccaacagugaccuuccgaaacagccuucugaauacaaagaggauucaguuuccaucuucucaacuuuuuaacacagaaauacuuccugcgagcauaucgacaacucucgggccaggcgcuguggcucacaccuauaaucccagcacuuuaggaggccgaggcaggcggauugccugagcucaggaguucaagaucagucugggcaacacgaugaaacuccgucucuacuaaaauacaaaaaauuauccaggcaugguggcguacgccuguagucccagcuacucaggaggcugaggcaggagaauugcuugaacccaggaggaagagguugcagugagccaagaucaugccacaucacuccaaccugggcaacagaacaagaacccaucucaaacaaacaaacaaacaaaaaaaaaaaacucuugucuccuuaggauauguuaccugcuccacugcagacuagagaaauaaauguguauugaaccuuuuacugcaaacuugaaaaugcuagaaaaccaagcaugaagaauaaauacauggugggaaacacacaggcaugugcauaugcauauacauuguaaguuaguaaguuagaaagcuagcuuuguuguaucugaacacaugaaucuuuuuuggucaguguaggaagcacagccagauccuauaggaaugaauaccucaaaucuguugucugagauucuagagauuaaaccacugugccauuuuuaacccaggcuguacuguuguuucuuaccaacagcauagguuuucaucacuggaaggagccuguguucauuuccuagggcugcuguagcaaaguaguacaaacuggauuguuuaaaccaacaaaaacucauugucucucaguucuggaggccagaaguucaaaaucaagguguugaccaaggccauucuccugaaagugcuagggaaggagcuguccacgccucccuccuggcuucugggagccucagguguuccuuggcuucuagaugcaucauuccaguccuccaucuucacauggcauucccucugugugucuccacagugucuucccucugugcagaucuaucucuguguccaagucuccucuuuuuauaaggaaaccagucauaauggacccaccugaaugaccucauuuuaacuugauuaccucuguaaaaaauguauuuccaaauaaagugaccuuaugagguauugaaaaaaaaaaaaaaaaaa

SEQ ID NO: 238 - RNA, 7757 nt, Homo_Sapiens
cucacugucccuggaaucuucaagggaguuacugcauuacaucaucagaaacaaggcauuucuauauuacuauggaaagauuucgucuggagaagaaguuaccugguccugaugaagaagcuguuguggaucuuggcaaaacuagcucaacugugaacaccaaguuugaaaaagaagaacuagaaagucauagagcuguauauauugguguucacgucccguuuaguaaagagagucgucggcgucauaggcaucgcggacacaaacaucaccaccggagaagaaaagauaaagaaucagauaaagaagauggacgggaaucuccuucuuaugauacaccaucccagagaguucaguuuauccuugguacugaagaugaugaugaagaacauauuccccaugaucucuucacggaaauggaugaacuguguuacagagauggagaagaauaugaauggaaagaaacugcuagauggcugaaauuugaagaggauguugaagauggcggugaccgauggaguaaaccuuauguggcaacucucucuuugcacagucuuuuugaacuaaggaguugcauccucaauggaacagucaugcuggauaugagagcaagcacucuagaugaaauagcagauaugguauuagacaacaugauagcuucuggccaauuagacgaguccauacgagagaaugucagagaagcucuucugaagagacaucaucaucagaaugagaaaagauucaccagucggauuccucuuguucgaucuuuugcagauauaggcaagaaacauucugacccucacuugcuugaaaggaauggggaaggccuuucagccucccgccacucuuugcgaacaggucugucugccucaaaccuuuccuugagaggagaaucaccuuuaucucuucuucuuggucaucuucuuccuucuucaagagcuggaaccccugcaggcucaagguguacaaccccaguacccaccccucaaaacaguccuccuucuagcccuagcaucagccgccugaccuccagaaguucccaagagagucagcgucaggccccagaacuacugguuucaccugccagugaugauauucccacaguaguaauucauccgccugaggaagacuuagaagcagcgcugaaaggcgaggagcagaagaaugaggaaaauguugacuuaacuccagguauuuuggccucuccccagucugcuccuggaaacuuggacaauaguaaaaguggagaaauuaaagguaauggaagugguggaagcagagaaaauaguacuguugacuucagcaagguugauaugaauuucaugagaaaaauuccuacgggugcugaggcauccaacguccuggugggcgaaguagacuuuuuggaaaggccaauaauugcauuugugagacuggcuccugcuguccuccuuacaggguugacugaggucccuguuccaaccagguuuuuguuuuuguuauuggguccagcgggcaaggcaccacaguaccaugaaauuggacgaucaauagccacucucaugacagaugagauuuuccaugauguagcuuauaaagcaaaagacagaaaugaccucuuaucuggaauugaugaauuuuuagaucaaguaacuguccuaccuccaggagagugggauccuucuauacgcauagaaccaccaaaaagugucccuucucaggaaaagagaaagauuccuguguuucacaauggaucuacccccacacugggugagacuccuaaagaggccgcucaucaugcugggccugagcuacagaggacuggacggcuuuuuggugguuugauacuugacaucaaaaggaaagcaccuuuuuucuugagugacuucaaggaugcauuaagccugcagugccuggccucgauucuuuuccuauacugugccuguaugucuccuguaaucacuuuuggagggcugcuuggagaagcuacagaaggcagaauaagugcaauagagucucuuuuuggagcaucauuaacugggauugccuauucauuguuugcugggcaaccucuaacaauauuggggagcacagguccaguucuaguguuugaaaaaauuuuauauaaauucugcagagauuaucaacuuucuuaucugucuuuaagaaccaguauuggucuguggacuucuuuuuugugcauuguuuugguugcaacagaugcaagcagccuuguguguuauauuacucgauuuacagaagaggcuuuugcagcccuuauuugcaucauauucaucuacgaggcuuuggagaagcucuuugauuuaggagaaacauaugcauuuaauaugcacaacaacuuagauaaacugaccagcuacucauguguauguacugaaccuccaaaccccagcaaugaaacucuagcacaauggaagaaagauaauauaacagcacacaauauuuccuggagaaaucuuacuguuucugaauguaaaaaacuucgugguguauucuuggggucagcuuguggucaucauggaccuuauauuccagaugugcucuuuuggugugucaucuuguuuuucacaacauuuuuucugucuucauuccucaagcaauuuaagaccaagcguuacuuuccuaccaaggugcgaucgacaaucagugauuuugcuguauuucucacaauaguaauaaugguuacaauugacuaccuuguaggaguuccaucuccuaaacuucauguuccugaaaaauuugagccuacucauccagagagaggguggaucauaagcccacugggagauaauccuugguggaccuuauuaauagcugcuauuccugcuuugcuuuguaccauucucaucuuuauggaucaacaaaucacagcuguaauuauaaacagaaaggaacacaaauugaagaaaggagcuggcuaucaccuugauuugcucaugguuggcguuauguugggaguuugcucugucaugggacuuccaugguuuguggcugcaacaguguugucaauaagucaugucaacagcuuaaaaguugaaucugaauguucugcuccaggggaacaacccaaguuuuugggaauucgugaacagcggguuacagggcuaaugauuuuuauucuaaugggccucucuguguucaugacuucaguccuaaaguuuauuccaaugccuguucuguaugguguuuuccuuuauaugggaguuuccucauuaaaaggaauccaguuauuugaccguauaaaauuauuuggaaugccugcuaagcaucagccugauuugauauaccuccguuaugugccgcucuggaagguccauauuuucacagucauucagcuuacuuguuugguccuuuuaugggugauaaaaguuucagcugcugcagugguuuuucccaugaugguucuugcauuaguguuugugcgcaaacucauggaccuguguuucacgaagagagaacuuaguuggcuugaugaucuuaugccagaaaguaagaaaaagaaagaagaugacaaaaagaaaaaagagaaagaggaagcugaacggaugcuucaagaugaugaugauacugugcaccuuccauuugaagggggaagucucuugcaaauuccagucaaggcccuaaaauauaguccugauaaaccugugagugugaaaauaaguuuugaagaugaaccaagaaagaaauacguggaugcugaaacuucauuauagaauugaaccaagaggcauuauacauauagauauauacauauguaaugugugcguaucaugucacuauauauaagaauauuguaugucaugcuguuuaugugugacuaccggguuuuuaaaaguagugucuggaguuuguaaugagcaccguggagacuauguauuuaaugaaaugcucucuuugaagugagguacaugguucuuaacuauucaaauauuuauucuguuagaaaaaaaaauuuucuguuuugcaauagaaggauguggagaaaugcuuucagucuacuuuucuuaaaucucuguucaucaguggcaauucguaaaaaccuuaagugauacuuuguuuauauguuuauaauuuuuagguguuuccugaaauuuucacauauuauuucacuuuuguuagugcuuuaugggaagaauagggagucuauaccagugcugugggaaaaaugguaacauuucagggcuucucuauuuguguuucauuucuguagauguccaucguguuucacuaacuggcguuuucuuagccauagagaugacuguagaacaauagaaacuuuaauaaugauaguuuuuaacuuuuauguuuaaauuuuuuuuaaaucuuaaaaccuucauaucuagguauccauugugacagacaaguaaaauugcaggugauuugauaauuaagcacccauaccauuuauaacuucugaauuuaaaaaguuauacaaugccaguuugcaauaguugauuuugaugccuuuguagaauauuuuuucugaauccuuaugcucuuuuaaagccaaugauucccacucuguucucugccuugucucucuuugucuuaaaaugcuuuaguuuccaucagguucaaguucuugacuauuauucucuuauaaguaguaggcguaaauaaucaggaguuagaauucucucagaagggucuaugaucaguauuacuuuauuaagaauuaccuuucauuuucucuuuauguuauucuuucacuuuuguagauuacauuuaauagcuuguuaccugugauuuuauuuuaaaauauuuauuuugauaugaugcuuaaauauuauauaaacauuuggaaaaguaacaaauagaguaaauuguuaauguaaauaguuggugcuuacuuucauuuauguuuauuaucuuaaagcaauugauagauuuuacaucuuugauauaaagcacugccauauuuauauuuuaaaaggaaauuagacauuuuauauguagcucagauuaaugacauuuuuauuuuguguauuaguuuuugcuuuucugagcuuuuuaaagucuaacaaaucuuuuuagucaucuuuuauauacuuuuaguuccacaugaaauaaauguuguuaagccuguaggacuggaugaaugggguugugaaacugauuugacaagagaauaauuuacaaaaaucaaaugaguauugagaagccacagaaauaucaaaaauggugacaucacuauuaggaugaaaauuuuaugaaauuccaaugcucccuuuaaccauauaauuaaauuacaaagguauacauaauuaaucuaauaaaggaucaugaggaaugccaaaagcugaaauuuuagcaagucugguguuuuaaauucauuauaaacuauuuauuaacuaauguaauguccuccucuaagaccauauuguaagagucuuguuaaaaugauggauucaacuucugccucggaugagagguuggaaauguagcugcuuuucuuuagaaaauauguagcugucaucauuugguacugccuaaaaagaguuagacucuauuggcaauugauagaguauuacccacggugcuuauuauuguuuaugagcuuccauuguaaugauuccuuuuuauuuguagcagcauaauuauuuccaaagaccccaguauuugcugcuauuuuuaaaacuccccugauguaccugaacaagaggauuuccucacaucauuuccuugugucuggacaucagggguaacaacuguacuuacuuuacaggaagaaauuuuaaaacugaaaacuaccugggaucauaguguuucugugauuuuauuuaauuguguauaguaauuauccagugccagaaaaaccgucacuugcaaaauacuuugcacucaaaauguuuuuacaaugcuucuaaauguuacugguuucugcuuucuuuugacuacuugacugacaaaaugaucugacuacuccauuuaagagcaaagguaacucauguuuagguaauuaacugcuuguuuuaagugauuauauuucuuccacuguuuuugaaaaauaaucaaagauagcauucauugagagacagugacagauauaauuuacuacauauauugauuuuuaaauaaaguugccuuaaauaaguguauguaagcaguaguaguugcuauguacugauuuaccucaaggugcaaaauaauuaaaccuguacauauuccauuuacaaaauaaauucagcccugcacuuucuuuagaugccuugauuuccagaauggagcuuagugcuacugaauacccuggccacagagccaccucaggauauucuuuucuccacccuaguuuauuuauuuauagauaucuguuuacaaagucuguaguaaauccugaugcugaccaucugaaauguacuuuuuuucugaaugcuguuucaaucuaaaauagcagcuuuugagaaaacaaugauguaaauuccuuaugauaaaaggaugauucuauauauucuuuaaugauauuaaauaugccgaagccaagcacacagucuuucuaaaguguguguauguuugugugaaugugaaugauacugaucuuauaucuguuaaaaguuguuuuaaaaagcuguggcaucccauuguucauauuugccaagucuucuguaaagaugucuaggacgaaauauuuuaugugcuaaugcauguauuuguaaaccagauuuguuuaccacucaaaauuaacuuguuuucuucauccaaaaaaguuuauuucuuccacguacuuaaauuuucuguguggguauaauauagcuuucuaauuuuuuucuuucacaaaggcagguucaaaauucuguugaaagaaaaaugcuuucugaaacugagguauaacaccagagcuugcuguuuaaaggauuauaugauguacaucaguucuauaaaugugcucagcaguuuaacaugugaauccuguuuuaaagugcucagauuucaacuguguaagccauugauauaacgcuguaauuaaaaauguuuauaugaaauaacuuaauguuuuaaauuuauuuauguagaucacaucauuuuuaucguaugcagugcaaauaugugaaaugucuuuugguuuauuccaacaauuauuuauuuuagaaaguaaguuuaaagacuuuaaggacauucaaaguuuaaaauaguguucaaauugcaaaauuuggcaaucuucauauaaauugguuucuuuucuaacuuuucaaaaacuaacauuaaaugucaauuauaggaaaacauaguuggaaauguaaucauccaaagaucauuuuuaaaaugaaauuuaauuagcacauauugaacauuugacuuaauuguuaaaccccaguuuuguuuuguuuuuuuaaucagauuuuugcacacugauuaguuuuuguguuguggcuuuuguugcuuuauuauucaagguuuuuuuuuuuuuucuuccccaugggggagauugucuuccaauguuuaacuacguuuaaauaaauaaaaauugaauuuuauuguucauuuauauaaaaucugauaccuugauguaauuucacaauacaguuccaauuuuuauggcuuuuauaauuacaaugauauuuucuucuauaauaaaauccaaaguaaacauuuaaauuguagaacugauauuuuucauuuauaugaaguauaagccucuacugggucuauauugugaaucauccugccuuucaaauuuguuucauaauuguuagaugaaaacuauuuuuuuggagauguuacugaaguugauugagcaauaaaagucuacuuaauua

SEQ ID NO: 239 - RNA, 2387 nt, Homo_Sapiens
agacaccucugcccucaccaugagccucuggcagccccugguccuggugcuccuggugcugggcugcugcuuugcugcccccagacagcgccaguccacccuugugcucuucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcucuucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuuuucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggcucccguccugcuuuggcagugccauguaaauccccacugggaccaacccuggggaaggagccaguuugccggauacaaacugguauucuguucuggaggaaagggaggaguggaggugggcugggcccucucuucucaccuuuguuuuuuguuggaguguuucuaauaaacuuggauucucuaaccuuuaaaaaaaaaaaaaaaaaaaaaaaaaaaaaaaaaaaaaaaaaaaaaaaaaaaa

SEQ ID NO: 240 - RNA, 4156 nt, Homo_Sapiens
auauauagaggcaggagcuggcauugggaaagucaaacuaguucugcaccaugaggaagaagcagcugaagacggaggcagcuccacacugugaacuaaaaucauauucuaagaacucagccacucagguauccaccauggugcuggguccugaacagaagaugucagaugacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgguaagcaucucuaaaggccugcugacagaagaagccacccguggcuacguuaaauaacacuggauuagucugucuucugcagguagccaucagagccaguguguuucuaugguuuacugugugaacauagccaaaaguaugugccguugcacagacuguguuuaugacucaaccguugguuggaaaagacuuuguuucauguguauuugaaagauggaauuauuuuuuccuuccugaccuaaccuuagaacuggauuagggugggaucuuugaaaagcugacauuugcugcuaucauuccaacacuaaauucuuaaguaguugcccaagggccagcucaguuuauccuucggagagacaaggauaugcaugauucuuaaccaggcuauauguuaaaaaaaaauuggaaaaugcaauacauuuuuuauuauacaaacuacagaaugaguaugcaaguuuuauuuaucaaaauguaauggauuuuuaaaggcugagaaauuuuccuuauaccuaccuuuucaguuauuuuaauuauaccaaauuaucaacuagaauagcuucauccauaugaaauauaaaaugaagagacaccuagcucuaucaggcuuaggauucuuugaacuuauuuccacuuuaauuucucaguggaaguuaagaggggugagaaaacaaagaaggggaaaaacugacaacuaacaaaaccagcaccacaucgcuagguggugcuuacuaauuaccuucucaggauuuuccucagauugaaaagcuuaugaggauuucuugggagucuuaauaaccugccuguuaguacagagcuuuccugaugauauuuacucuugagcacaugugguuguaaaaccuuaacuuucuuucuccaggaggguggugauagaaacagaugguaguauuuaugaacugauguucucgugaaauguugaggguggggagaaaagacuuuaagggaggagagccaucuauuuuguuccuaaagccaccucucagcagaaucgucauguuuuucugaugcaccgcucugcuucaugcccaagaugacuugcgaggcaaucucaggagcuguggacuuaaccguugcaaagcacacugucuuucucagcguucucugcaagucaguagguguuaguaugguugcaaaguucacugucucagcaaaguugaacugggcuaccucucuacagcuguuuccucagagggaaaaaucuugagaccagaugguggagcucuggagucagaggaaaugggugucuucagcacaaagcugcugcuuuuacuucagccacuucugacauuuuuacauaccgagccugagauugugugauuaucucaaaucaaaucacuuugauggagauaaauaaucaaaacuguuuuauagucauugauuuggugagaacaguaauggaaaaugguguugaaggacuucucauuuuuggagcuuuccuuccagaguccuggcugauugguguucgcuguucaucugagcccccaaaagcauuauuacugauacuugcacacagucaaaagcgcagacuggauggauggucuuuuauaaggcauuuaaggguacacuacuguguuucacugaccauacauuuuucuuagccccucaaguaauauagcacagaguuaugaaugacaauuccccuaaccauuccucuucauaucugccucuuccccuuaccaucguaauucuccaaacuggucauaaaggcacucugugaagauauuggggacugacaucuuaagcucucaccuggcugcaguaggaaaggccaaacugacgacaaaaaaaaaauucuuuauaaagaugauaugguaacauguaucuuugcccugggucuggguggguccagucagucucagauuuacaagcauuuaggagccuagguaaaagcugcuaguauucuuuuaaaaguuauauuuaugacuugcaaugauagaaaacuccuuccaauuaaauggcauuuuauaauauuauguguguacuucacaguguuaaaaauacccucauacguuauugcauuugaucuucacagaaagugcauuuuaaccaguacucugggugcaauaaauaauauguagaaauuuaaguccuccaauuccagcauauccagugaguuuugacaguguguuuauguggaauguuuaaggauauacaauuguacuuuauauaaauugguucuuguucuucuuaaaugugacaugaaauaauugugcugcuacauuauacuggaaauuaacaggggaaaagggaagagcucuuggcucccuugagguucugcuagugguguuaggagugguuacaacugagcuuuuaguaaccauuuaaccguauguaaacuugguuucuaauuaaaaaaaaauuucuuuuuccaa

SEQ ID NO: 241 - RNA, 3795 nt, Homo_Sapiens
cgaccaaucgcggggaggggagggcguuagccagcguggcgcuggcucccggaauauggagcccugggcgcgggggcggcgugucaggugguugcggagcugguaagaaucauauucuaagaacucagccacucagguauccaccauggugcuggguccugaacagaagaugucagaugacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgugccaucugggauugacagcucagccugaacucuaucuucugaacaccauggacgcugacucacuugugucuagaugacugacagccugagagacucuauaagaacauguuuuucuaagcccuuuuugugccaggugucccguuaacgucucuguuaguucagaggugaguuuuguucagacguuuugaacaaaaggcaaagauuuccucaugggaaggguguucaaaacugacagcuauaaauguaggucagagacccacccaccucauaacagucauacacucccagaguuaaacgauuggccucugauggccacacaccccuaugggcuugugucuuggacucugggauuuaaaagauauauauguauauauauuuauguaaaccugagcaucucaguuuggguagaguuuuaagguuauaugaaacugauagaacuuuuguauuuuuuuuuuaaauauuguuuugauauaucagauauuuguuuugucuggaucacaagugagaaagaaaagagaacaaugcucuuuuucacaaugaacuggucaaauugacuaucuuguaaagugauacuuuacuaugucagugaaauuucaguuugauuuuagucaaccagauuauauccuuuguaucuacugauauuaacacaucauauuaacacaucauuucuuaaaaaaacauuucuucuguuuggcaaucauaauuaacucugguuaucagccuauuuuguaauuauugucuuugucgucacuuuucuugaauuguuuucuagucauuaaacagauaugaaggcauugccaaagagcuuuaauauccaguaacaagauccagaaaccacacuuuaaccagugaucaguuuuccgugcugcauuguaacucagcucauucuggcauucaaguuuuaggcaaaaaaagaggaaacuucuaacauuuagcuuguaaguccugacauaagauagugaagauauuuaucuucuuucuaauauuuguauaguccgccaauguauuuucuucccacuauucccauuaacauaccaaacacuguuucuagguccaaagucuauuucuaggaguggccaauauuuguauuguugaaucuccuagggaaugcuaaauguuucacuuuaaaauaccuauuuauaccaaguagcaugagauuaguacuagagugagauuuggaauauuaguccacauaucacaaacugcuugccuacauguauagauuuuuuuuuucacccaccuuccuaaccaggaauuuguuuccuuaaauuuguuguuguuguuguuguuguuuguuguuauuuuuuugagaagagucuugcccugucgccaaggugggaaugcauugacgugaucucaguucacuguaaccucuaccuccccgguuuaaucgauucuccuccuucagccuccugaauagcugggauuacaggcaccacauuuuuaguggagaugggguuucaccauguuggccaggcuggucucaaacucuugaccucaagugaucuaccugccucagccucccaaagugcugggauuacaggugugagccacugcacccagcguuuuuuguuguuaagacagggucuugcucuguugcccaggcuggagugcaguggugugaucucagcucacugcaacuucugccaccugggcuuaagccauccucccacuucagcaucccaaauagcugggacugcaggcacacaccaccacacccagcuaauuuuuguauuuuuuguagagacgggauuucaccauguugcccaggcugguguugaacucaugagcucaaguaaucugcuggccuuggccucccaaagugcugagauuauaggcgugagccacugcauccagcucacuccucauuucuuucuagccccaaagguguugagucagcaaauccugcagccuuugugugacuuugagcaucacuuuccccuuucagcauuaaauauaugaccucucugccuuauuuuagaacuuacuacauuucaauaaaacuuuuuaaaaaauccag

SEQ ID NO: 242 - RNA, 3790 nt, Homo_Sapiens
cgaccaaucgcggggaggggagggcguuagccagcguggcgcuggcucccggaauauggagcccugggcgcgggggcggcgugucaggugguugcggagcugaaucauauucuaagaacucagccacucagguauccaccauggugcuggguccugaacagaagaugucagaugacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgugccaucugggauugacagcucagccugaacucuaucuucugaacaccauggacgcugacucacuugugucuagaugacugacagccugagagacucuauaagaacauguuuuucuaagcccuuuuugugccaggugucccguuaacgucucuguuaguucagaggugaguuuuguucagacguuuugaacaaaaggcaaagauuuccucaugggaaggguguucaaaacugacagcuauaaauguaggucagagacccacccaccucauaacagucauacacucccagaguuaaacgauuggccucugauggccacacaccccuaugggcuugugucuuggacucugggauuuaaaagauauauauguauauauauuuauguaaaccugagcaucucaguuuggguagaguuuuaagguuauaugaaacugauagaacuuuuguauuuuuuuuuuaaauauuguuuugauauaucagauauuuguuuugucuggaucacaagugagaaagaaaagagaacaaugcucuuuuucacaaugaacuggucaaauugacuaucuuguaaagugauacuuuacuaugucagugaaauuucaguuugauuuuagucaaccagauuauauccuuuguaucuacugauauuaacacaucauauuaacacaucauuucuuaaaaaaacauuucuucuguuuggcaaucauaauuaacucugguuaucagccuauuuuguaauuauugucuuugucgucacuuuucuugaauuguuuucuagucauuaaacagauaugaaggcauugccaaagagcuuuaauauccaguaacaagauccagaaaccacacuuuaaccagugaucaguuuuccgugcugcauuguaacucagcucauucuggcauucaaguuuuaggcaaaaaaagaggaaacuucuaacauuuagcuuguaaguccugacauaagauagugaagauauuuaucuucuuucuaauauuuguauaguccgccaauguauuuucuucccacuauucccauuaacauaccaaacacuguuucuagguccaaagucuauuucuaggaguggccaauauuuguauuguugaaucuccuagggaaugcuaaauguuucacuuuaaaauaccuauuuauaccaaguagcaugagauuaguacuagagugagauuuggaauauuaguccacauaucacaaacugcuugccuacauguauagauuuuuuuuuucacccaccuuccuaaccaggaauuuguuuccuuaaauuuguuguuguuguuguuguuguuuguuguuauuuuuuugagaagagucuugcccugucgccaaggugggaaugcauugacgugaucucaguucacuguaaccucuaccuccccgguuuaaucgauucuccuccuucagccuccugaauagcugggauuacaggcaccacauuuuuaguggagaugggguuucaccauguuggccaggcuggucucaaacucuugaccucaagugaucuaccugccucagccucccaaagugcugggauuacaggugugagccacugcacccagcguuuuuuguuguuaagacagggucuugcucuguugcccaggcuggagugcaguggugugaucucagcucacugcaacuucugccaccugggcuuaagccauccucccacuucagcaucccaaauagcugggacugcaggcacacaccaccacacccagcuaauuuuuguauuuuuuguagagacgggauuucaccauguugcccaggcugguguugaacucaugagcucaaguaaucugcuggccuuggccucccaaagugcugagauuauaggcgugagccacugcauccagcucacuccucauuucuuucuagccccaaagguguugagucagcaaauccugcagccuuugugugacuuugagcaucacuuuccccuuucagcauuaaauauaugaccucucugccuuauuuuagaacuuacuacauuucaauaaaacuuuuuaaaaaauccag

SEQ ID NO: 243 - RNA, 4159 nt, Homo_Sapiens
cgaccaaucgcggggaggggagggcguuagccagcguggcgcuggcucccggaauauggagcccugggcgcgggggcggcgugucaggugguugcggagcugaaucauauucuaagaacucagccacucagguauccaccauggugcuggguccugaacagaagaugucagaugacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgguaagcaucucuaaaggccugcugacagaagaagccacccguggcuacguuaaauaacacuggauuagucugucuucugcagguagccaucagagccaguguguuucuaugguuuacugugugaacauagccaaaaguaugugccguugcacagacuguguuuaugacucaaccguugguuggaaaagacuuuguuucauguguauuugaaagauggaauuauuuuuuccuuccugaccuaaccuuagaacuggauuagggugggaucuuugaaaagcugacauuugcugcuaucauuccaacacuaaauucuuaaguaguugcccaagggccagcucaguuuauccuucggagagacaaggauaugcaugauucuuaaccaggcuauauguuaaaaaaaaauuggaaaaugcaauacauuuuuuauuauacaaacuacagaaugaguaugcaaguuuuauuuaucaaaauguaauggauuuuuaaaggcugagaaauuuuccuuauaccuaccuuuucaguuauuuuaauuauaccaaauuaucaacuagaauagcuucauccauaugaaauauaaaaugaagagacaccuagcucuaucaggcuuaggauucuuugaacuuauuuccacuuuaauuucucaguggaaguuaagaggggugagaaaacaaagaaggggaaaaacugacaacuaacaaaaccagcaccacaucgcuagguggugcuuacuaauuaccuucucaggauuuuccucagauugaaaagcuuaugaggauuucuugggagucuuaauaaccugccuguuaguacagagcuuuccugaugauauuuacucuugagcacaugugguuguaaaaccuuaacuuucuuucuccaggaggguggugauagaaacagaugguaguauuuaugaacugauguucucgugaaauguugaggguggggagaaaagacuuuaagggaggagagccaucuauuuuguuccuaaagccaccucucagcagaaucgucauguuuuucugaugcaccgcucugcuucaugcccaagaugacuugcgaggcaaucucaggagcuguggacuuaaccguugcaaagcacacugucuuucucagcguucucugcaagucaguagguguuaguaugguugcaaaguucacugucucagcaaaguugaacugggcuaccucucuacagcuguuuccucagagggaaaaaucuugagaccagaugguggagcucuggagucagaggaaaugggugucuucagcacaaagcugcugcuuuuacuucagccacuucugacauuuuuacauaccgagccugagauugugugauuaucucaaaucaaaucacuuugauggagauaaauaaucaaaacuguuuuauagucauugauuuggugagaacaguaauggaaaaugguguugaaggacuucucauuuuuggagcuuuccuuccagaguccuggcugauugguguucgcuguucaucugagcccccaaaagcauuauuacugauacuugcacacagucaaaagcgcagacuggauggauggucuuuuauaaggcauuuaaggguacacuacuguguuucacugaccauacauuuuucuuagccccucaaguaauauagcacagaguuaugaaugacaauuccccuaaccauuccucuucauaucugccucuuccccuuaccaucguaauucuccaaacuggucauaaaggcacucugugaagauauuggggacugacaucuuaagcucucaccuggcugcaguaggaaaggccaaacugacgacaaaaaaaaaauucuuuauaaagaugauaugguaacauguaucuuugcccugggucuggguggguccagucagucucagauuuacaagcauuuaggagccuagguaaaagcugcuaguauucuuuuaaaaguuauauuuaugacuugcaaugauagaaaacuccuuccaauuaaauggcauuuuauaauauuauguguguacuucacaguguuaaaaauacccucauacguuauugcauuugaucuucacagaaagugcauuuuaaccaguacucugggugcaauaaauaauauguagaaauuuaaguccuccaauuccagcauauccagugaguuuugacaguguguuuauguggaauguuuaaggauauacaauuguacuuuauauaaauugguucuuguucuucuuaaaugugacaugaaauaauugugcugcuacauuauacuggaaauuaacaggggaaaagggaagagcucuuggcucccuugagguucugcuagugguguuaggagugguuacaacugagcuuuuaguaaccauuuaaccguauguaaacuugguuucuaauuaaaaaaaaauuucuuuuuccaa

SEQ ID NO: 244 - RNA, 4424 nt, Homo_Sapiens
agaguccaggacugauggagucgcgccauucagagaaagacccaaagaugggggcagggagggaacgccggaggucgcgggggucucgccccuuccccgccgcggccuaggacacauggcccagcucccagcugcaccggauggcgcgcccggccugugucggggugcgcugaccugcuucgacgccucgaaagaggccgacgggcacagggcaaggucuuucguggccucuucgucggcgccgcagggggccgggcugcucuccggggccucccgccgccccgcuucaacaaaagacucauuauaaccuaaccgacuucagggagcgccuucugugugaauagccugcauacgcggcucaguaauuaaucauauucuaagaacucagccacucagguauccaccauggugcuggguccugaacagaagaugucagaugacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgguaagcaucucuaaaggccugcugacagaagaagccacccguggcuacguuaaauaacacuggauuagucugucuucugcagguagccaucagagccaguguguuucuaugguuuacugugugaacauagccaaaaguaugugccguugcacagacuguguuuaugacucaaccguugguuggaaaagacuuuguuucauguguauuugaaagauggaauuauuuuuuccuuccugaccuaaccuuagaacuggauuagggugggaucuuugaaaagcugacauuugcugcuaucauuccaacacuaaauucuuaaguaguugcccaagggccagcucaguuuauccuucggagagacaaggauaugcaugauucuuaaccaggcuauauguuaaaaaaaaauuggaaaaugcaauacauuuuuuauuauacaaacuacagaaugaguaugcaaguuuuauuuaucaaaauguaauggauuuuuaaaggcugagaaauuuuccuuauaccuaccuuuucaguuauuuuaauuauaccaaauuaucaacuagaauagcuucauccauaugaaauauaaaaugaagagacaccuagcucuaucaggcuuaggauucuuugaacuuauuuccacuuuaauuucucaguggaaguuaagaggggugagaaaacaaagaaggggaaaaacugacaacuaacaaaaccagcaccacaucgcuagguggugcuuacuaauuaccuucucaggauuuuccucagauugaaaagcuuaugaggauuucuugggagucuuaauaaccugccuguuaguacagagcuuuccugaugauauuuacucuugagcacaugugguuguaaaaccuuaacuuucuuucuccaggaggguggugauagaaacagaugguaguauuuaugaacugauguucucgugaaauguugaggguggggagaaaagacuuuaagggaggagagccaucuauuuuguuccuaaagccaccucucagcagaaucgucauguuuuucugaugcaccgcucugcuucaugcccaagaugacuugcgaggcaaucucaggagcuguggacuuaaccguugcaaagcacacugucuuucucagcguucucugcaagucaguagguguuaguaugguugcaaaguucacugucucagcaaaguugaacugggcuaccucucuacagcuguuuccucagagggaaaaaucuugagaccagaugguggagcucuggagucagaggaaaugggugucuucagcacaaagcugcugcuuuuacuucagccacuucugacauuuuuacauaccgagccugagauugugugauuaucucaaaucaaaucacuuugauggagauaaauaaucaaaacuguuuuauagucauugauuuggugagaacaguaauggaaaaugguguugaaggacuucucauuuuuggagcuuuccuuccagaguccuggcugauugguguucgcuguucaucugagcccccaaaagcauuauuacugauacuugcacacagucaaaagcgcagacuggauggauggucuuuuauaaggcauuuaaggguacacuacuguguuucacugaccauacauuuuucuuagccccucaaguaauauagcacagaguuaugaaugacaauuccccuaaccauuccucuucauaucugccucuuccccuuaccaucguaauucuccaaacuggucauaaaggcacucugugaagauauuggggacugacaucuuaagcucucaccuggcugcaguaggaaaggccaaacugacgacaaaaaaaaaauucuuuauaaagaugauaugguaacauguaucuuugcccugggucuggguggguccagucagucucagauuuacaagcauuuaggagccuagguaaaagcugcuaguauucuuuuaaaaguuauauuuaugacuugcaaugauagaaaacuccuuccaauuaaauggcauuuuauaauauuauguguguacuucacaguguuaaaaauacccucauacguuauugcauuugaucuucacagaaagugcauuuuaaccaguacucugggugcaauaaauaauauguagaaauuuaaguccuccaauuccagcauauccagugaguuuugacaguguguuuauguggaauguuuaaggauauacaauuguacuuuauauaaauugguucuuguucuucuuaaaugugacaugaaauaauugugcugcuacauuauacuggaaauuaacaggggaaaagggaagagcucuuggcucccuugagguucugcuagugguguuaggagugguuacaacugagcuuuuaguaaccauuuaaccguauguaaacuugguuucuaauuaaaaaaaaauuucuuuuuccaa

SEQ ID NO: 245 - RNA, 4139 nt, Homo_Sapiens
acuuuacugcaagccuuagucagaguacaaaggguuccugcuuggugguuuugcugcagcuucagaguuuagccugaacuguggcaggauuuuguaacuugcacauuuuuugagaagucugauggagguauaauguccacggucgauuauuugaacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgguaagcaucucuaaaggccugcugacagaagaagccacccguggcuacguuaaauaacacuggauuagucugucuucugcagguagccaucagagccaguguguuucuaugguuuacugugugaacauagccaaaaguaugugccguugcacagacuguguuuaugacucaaccguugguuggaaaagacuuuguuucauguguauuugaaagauggaauuauuuuuuccuuccugaccuaaccuuagaacuggauuagggugggaucuuugaaaagcugacauuugcugcuaucauuccaacacuaaauucuuaaguaguugcccaagggccagcucaguuuauccuucggagagacaaggauaugcaugauucuuaaccaggcuauauguuaaaaaaaaauuggaaaaugcaauacauuuuuuauuauacaaacuacagaaugaguaugcaaguuuuauuuaucaaaauguaauggauuuuuaaaggcugagaaauuuuccuuauaccuaccuuuucaguuauuuuaauuauaccaaauuaucaacuagaauagcuucauccauaugaaauauaaaaugaagagacaccuagcucuaucaggcuuaggauucuuugaacuuauuuccacuuuaauuucucaguggaaguuaagaggggugagaaaacaaagaaggggaaaaacugacaacuaacaaaaccagcaccacaucgcuagguggugcuuacuaauuaccuucucaggauuuuccucagauugaaaagcuuaugaggauuucuugggagucuuaauaaccugccuguuaguacagagcuuuccugaugauauuuacucuugagcacaugugguuguaaaaccuuaacuuucuuucuccaggaggguggugauagaaacagaugguaguauuuaugaacugauguucucgugaaauguugaggguggggagaaaagacuuuaagggaggagagccaucuauuuuguuccuaaagccaccucucagcagaaucgucauguuuuucugaugcaccgcucugcuucaugcccaagaugacuugcgaggcaaucucaggagcuguggacuuaaccguugcaaagcacacugucuuucucagcguucucugcaagucaguagguguuaguaugguugcaaaguucacugucucagcaaaguugaacugggcuaccucucuacagcuguuuccucagagggaaaaaucuugagaccagaugguggagcucuggagucagaggaaaugggugucuucagcacaaagcugcugcuuuuacuucagccacuucugacauuuuuacauaccgagccugagauugugugauuaucucaaaucaaaucacuuugauggagauaaauaaucaaaacuguuuuauagucauugauuuggugagaacaguaauggaaaaugguguugaaggacuucucauuuuuggagcuuuccuuccagaguccuggcugauugguguucgcuguucaucugagcccccaaaagcauuauuacugauacuugcacacagucaaaagcgcagacuggauggauggucuuuuauaaggcauuuaaggguacacuacuguguuucacugaccauacauuuuucuuagccccucaaguaauauagcacagaguuaugaaugacaauuccccuaaccauuccucuucauaucugccucuuccccuuaccaucguaauucuccaaacuggucauaaaggcacucugugaagauauuggggacugacaucuuaagcucucaccuggcugcaguaggaaaggccaaacugacgacaaaaaaaaaauucuuuauaaagaugauaugguaacauguaucuuugcccugggucuggguggguccagucagucucagauuuacaagcauuuaggagccuagguaaaagcugcuaguauucuuuuaaaaguuauauuuaugacuugcaaugauagaaaacuccuuccaauuaaauggcauuuuauaauauuauguguguacuucacaguguuaaaaauacccucauacguuauugcauuugaucuucacagaaagugcauuuuaaccaguacucugggugcaauaaauaauauguagaaauuuaaguccuccaauuccagcauauccagugaguuuugacaguguguuuauguggaauguuuaaggauauacaauuguacuuuauauaaauugguucuuguucuucuuaaaugugacaugaaauaauugugcugcuacauuauacuggaaauuaacaggggaaaagggaagagcucuuggcucccuugagguucugcuagugguguuaggagugguuacaacugagcuuuuaguaaccauuuaaccguauguaaacuugguuucuaauuaaaaaaaaauuucuuuuuccaa

SEQ ID NO: 246 - RNA, 4084 nt, Homo_Sapiens
cgaccaaucgcggggaggggagggcguuagccagcguggcgcuggcucccggaauauggagcccugggcgcgggggcggcgugucaggugguugcggagcugguaagaaucauauucuaagaacucagccacucagguauccaccauggugcuggguccugaacagaagaugucagauguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgguaagcaucucuaaaggccugcugacagaagaagccacccguggcuacguuaaauaacacuggauuagucugucuucugcagguagccaucagagccaguguguuucuaugguuuacugugugaacauagccaaaaguaugugccguugcacagacuguguuuaugacucaaccguugguuggaaaagacuuuguuucauguguauuugaaagauggaauuauuuuuuccuuccugaccuaaccuuagaacuggauuagggugggaucuuugaaaagcugacauuugcugcuaucauuccaacacuaaauucuuaaguaguugcccaagggccagcucaguuuauccuucggagagacaaggauaugcaugauucuuaaccaggcuauauguuaaaaaaaaauuggaaaaugcaauacauuuuuuauuauacaaacuacagaaugaguaugcaaguuuuauuuaucaaaauguaauggauuuuuaaaggcugagaaauuuuccuuauaccuaccuuuucaguuauuuuaauuauaccaaauuaucaacuagaauagcuucauccauaugaaauauaaaaugaagagacaccuagcucuaucaggcuuaggauucuuugaacuuauuuccacuuuaauuucucaguggaaguuaagaggggugagaaaacaaagaaggggaaaaacugacaacuaacaaaaccagcaccacaucgcuagguggugcuuacuaauuaccuucucaggauuuuccucagauugaaaagcuuaugaggauuucuugggagucuuaauaaccugccuguuaguacagagcuuuccugaugauauuuacucuugagcacaugugguuguaaaaccuuaacuuucuuucuccaggaggguggugauagaaacagaugguaguauuuaugaacugauguucucgugaaauguugaggguggggagaaaagacuuuaagggaggagagccaucuauuuuguuccuaaagccaccucucagcagaaucgucauguuuuucugaugcaccgcucugcuucaugcccaagaugacuugcgaggcaaucucaggagcuguggacuuaaccguugcaaagcacacugucuuucucagcguucucugcaagucaguagguguuaguaugguugcaaaguucacugucucagcaaaguugaacugggcuaccucucuacagcuguuuccucagagggaaaaaucuugagaccagaugguggagcucuggagucagaggaaaugggugucuucagcacaaagcugcugcuuuuacuucagccacuucugacauuuuuacauaccgagccugagauugugugauuaucucaaaucaaaucacuuugauggagauaaauaaucaaaacuguuuuauagucauugauuuggugagaacaguaauggaaaaugguguugaaggacuucucauuuuuggagcuuuccuuccagaguccuggcugauugguguucgcuguucaucugagcccccaaaagcauuauuacugauacuugcacacagucaaaagcgcagacuggauggauggucuuuuauaaggcauuuaaggguacacuacuguguuucacugaccauacauuuuucuuagccccucaaguaauauagcacagaguuaugaaugacaauuccccuaaccauuccucuucauaucugccucuuccccuuaccaucguaauucuccaaacuggucauaaaggcacucugugaagauauuggggacugacaucuuaagcucucaccuggcugcaguaggaaaggccaaacugacgacaaaaaaaaaauucuuuauaaagaugauaugguaacauguaucuuugcccugggucuggguggguccagucagucucagauuuacaagcauuuaggagccuagguaaaagcugcuaguauucuuuuaaaaguuauauuuaugacuugcaaugauagaaaacuccuuccaauuaaauggcauuuuauaauauuauguguguacuucacaguguuaaaaauacccucauacguuauugcauuugaucuucacagaaagugcauuuuaaccaguacucugggugcaauaaauaauauguagaaauuuaaguccuccaauuccagcauauccagugaguuuugacaguguguuuauguggaauguuuaaggauauacaauuguacuuuauauaaauugguucuuguucuucuuaaaugugacaugaaauaauugugcugcuacauuauacuggaaauuaacaggggaaaagggaagagcucuuggcucccuugagguucugcuagugguguuaggagugguuacaacugagcuuuuaguaaccauuuaaccguauguaaacuugguuucuaauuaaaaaaaaauuucuuuuuccaa

SEQ ID NO: 247 - RNA, 2210 nt, Homo_Sapiens
cgaccaaucgcggggaggggagggcguuagccagcguggcgcuggcucccggaauauggagcccugggcgcgggggcggcgugucaggugguugcggagcugaaucauauucuaagaacucagccacucagguauccaccauggugcuggguccugaacagaagaugucagaugacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggaguacucuuguuuuagcuuucguaaacucugggcuuucaccggaccagguuuucuuaugagcauugccuaccuggauccaggaaauauugaauccgauuugcagucuggagcaguggcuggauuuaaguugcucuggauccuucuguuggccacccuuguggggcugcugcuccagcggcuugcagcuagacugggagugguuacugggcugcaucuugcugaaguaugucaccgucaguaucccaaggucccacgagucauccuguggcugaugguggaguuggcuaucaucggcucagacaugcaagaagucauuggcucagccauugcuaucaaucuucugucuguaggaagaauuccucugugggguggcguucucaucaccauugcagauacuuuuguauuucucuucuuggacaaauauggcuugcggaagcuagaagcauuuuuuggcuuucucaucacuauuauggcccucacauuuggauaugaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcaggugguugaagucuguacaaauaccagcaguccucaugcuggccucuuuccuaaagauaacucgacacuggcuguggacaucuacaaaggggguguugugcugggauguuacuuugggccugcugcacucuacauuugggcaguggggauccuggcugcaggacagagcuccaccaugacaggaaccuauucuggccaguuugucauggagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacagcuucccuuugcucucauacccauccucacauuuacgagcuugcggccaguaaugagugacuuugccaauggacuaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuuggguuggcaauguuugauugcacugggcauguccuuccuggacugugggcauacgugccaucugggauugacagcucagccugaacucuaucuucugaacaccauggacgcugacucacuugugucuagaugacugacagccugagagacucuauaagaacauguuuuucuaagcccuuuuugugccaggugucccguuaacgucucuguuaguucagagagacgggauuucaccauguugcccaggcugguguugaacucaugagcucaaguaaucugcuggccuuggccucccaaagugcugagauuauaggcgugagccacugcauccagcucacuccucauuucuuucuagccccaaagguguugagucagcaaauccugcagccuuugugugacuuugagcaucacuuuccccuuucagcauuaaauauaugaccucucugccuuauuuuagaacuuacuacauuucaauaaaacuuuuuaaaaaauccag

SEQ ID NO: 248 - RNA, 6982 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagucacucaaugagacggcucuuccagucuuacaauggagaaagugaggcucagagacuuuaaguaacuuaccuuagacgacuuuacuaguaaguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaucacaacucagaaguagaugaaggaaaauucugaucagcugacauccucuuaauacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 249 - RNA, 6824 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaucacaacucagaaguagaugaaggaaaauucugaucagcugacauccucuuaauacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 250 - RNA, 6814 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 251 - RNA, 6684 nt, Homo_Sapiens
gagaggggcagggggcggagcuggagggggugguucggcgugggggccguuggcuccagacaaauaaacauggaguccaucuuccacgagaaacagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaguaaaguaguugacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 252 - RNA, 6713 nt, Homo_Sapiens
gagaggggcagggggcggagcuggagggggugguucggcgugggggccguuggcuccagacaaauaaacauggaguccaucuuccacgagaaaguuauaagcaaugccuugaaaguuugggguuuagaacuaauccuguucaacaguccagaguaucagaggcucaggaucgauccuauaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 253 - RNA, 6526 nt, Homo_Sapiens
gagaggggcagggggcggagcuggagggggugguucggcgugggggccguuggcuccagacaaauaaacauggaguccaucuuccacgagaaaguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaucacaacucagaaguagaugaaggaaaauucugaucagcugacauccucuuaauacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 254 - RNA, 6560 nt, Homo_Sapiens
gagaggggcagggggcggagcuggagggggugguucggcgugggggccguuggcuccagacaaauaaacauggaguccaucuuccacgagaaaugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 255 - RNA, 6438 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagguuauaagcaaugccuugaaaguuugggguuuagaacuaauccuguucaacaguccagaguaucagaggcucaggaucgauccuauaaaugaaagaucauuuauaugcaauuauaaggaacacugguuuacaguuagaaaauuaggaaaacagacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 256 - RNA, 6352 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagaaaugaaagaucauuuauaugcaauuauaaggaacacugguuuacaguuagaaaauuaggaaaacagacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 257 - RNA, 6240 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 258 - RNA, 6977 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagguuauaagcaaugccuugaaaguuugggguuuagaacuaauccuguucaacaguccagaguaucagaggcucaggaucgauccuauaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaucacaacucagaaguagaugaaggaaaauucugaucagcugacauccucuuaauacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 259 - RNA, 6846 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaucacaacucagaaguagaugaaggaaaauucugaucagcugacauccucuuaauacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 260 - RNA, 6672 nt, Homo_Sapiens
gagaggggcagggggcggagcuggagggggugguucggcgugggggccguuggcuccagacaaauaaacauggaguccaucuuccacgagaaacagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 261 - RNA, 6923 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagguuauaagcaaugccuugaaaguuugggguuuagaacuaauccuguucaacaguccagaguaucagaggcucaggaucgauccuauaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 262 - RNA, 6120 nt, Homo_Sapiens
gagaggggcagggggcggagcuggagggggugguucggcgugggggccguuggcuccagacaaauaaacauggaguccaucuuccacgagaaacagccuucuggaaauauggaugacagugguuuuuucucuauucagacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 263 - RNA, 6837 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 264 - RNA, 6826 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaguaaaguaguugacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 265 - RNA, 6835 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagguuauaagcaaugccuugaaaguuugggguuuagaacuaauccuguucaacaguccagaguaucagaggcucaggaucgauccuauaaaugaaagaucauuuauaugcaauuauaaggaacacugguuuacaguuagaaaauuaggaaaacagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 266 - RNA, 6075 nt, Homo_Sapiens
gagaggggcagggggcggagcuggagggggugguucggcgugggggccguuggcuccagacaaauaaacauggaguccaucuuccacgagaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 267 - RNA, 6726 nt, Homo_Sapiens
gagaggggcagggggcggagcuggagggggugguucggcgugggggccguuggcuccagacaaauaaacauggaguccaucuuccacgagaaacagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaucacaacucagaaguagaugaaggaaaauucugaucagcugacauccucuuaauacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 268 - RNA, 6838 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagugguuuaacuugaauucucucuugacggguccagaauuaauaucagauacauaucuugcacuuuucuuggcucaauuacaacaggaagucacucaaugagacggcucuuccagucuuacaauggagaaagugaggcucagagacuuuaaguaacuuaccuuagacgacuuuacuaguaaggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 269 - RNA, 6770 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 270 - RNA, 6670 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 271 - RNA, 6891 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaucacaacucagaaguagaugaaggaaaauucugaucagcugacauccucuuaauacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 272 - RNA, 6285 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagcagccuucuggaaauauggaugacagugguuuuuucucuauucagacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 273 - RNA, 6627 nt, Homo_Sapiens
gagaggggcagggggcggagcuggagggggugguucggcgugggggccguuggcuccagacaaauaaacauggaguccaucuuccacgagaaaaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 274 - RNA, 6339 nt, Homo_Sapiens
gagaggggcagggggcggagcuggagggggugguucggcgugggggccguuggcuccagacaaauaaacauggaguccaucuuccacgagaaaaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 275 - RNA, 6472 nt, Homo_Sapiens
gagaggggcagggggcggagcuggagggggugguucggcgugggggccguuggcuccagacaaauaaacauggaguccaucuuccacgagaaaguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 276 - RNA, 6878 nt, Homo_Sapiens
gagaggggcagggggcggagcuggagggggugguucggcgugggggccguuggcuccagacaaauaaacauggaguccaucuuccacgagaaacaagaaggcucacuuugugcucaacauugccugaauaacuuauugcaaggagaauauuuuagcccuguggaauuauccucaauugcacaucagcuggaugaggaggagaggaugagaauggcagaaggaggaguuacuagugaagauuaucgcacguuuuuacagguuauaagcaaugccuugaaaguuugggguuuagaacuaauccuguucaacaguccagaguaucagaggcucaggaucgauccuauaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 277 - RNA, 6758 nt, Homo_Sapiens
gagaggggcagggggcggagcuggagggggugguucggcgugggggccguuggcuccagacaaauaaacauggaguccaucuuccacgagaaacagccuucuggaaauauggaugacagugguuuuuucucuauucagguuauaagcaaugccuugaaaguuugggguuuagaacuaauccuguucaacaguccagaguaucagaggcucaggaucgauccuauaaaugaaagaucauuuauaugcaauuauaaggaacacugguuuacaguuagaaaauuaggaaaacagugguuuaacuugaauucucucuugacggguccagaauuaauaucagauacauaucuugcacuuuucuuggcucaauuacaacaggaagguuauucuauauuugucguuaagggugaucugccagauugcgaagcugaccaacuccugcagaugauuaggguccaacagaugcaucgaccaaaacuuauuggagaagaauuagcacaacuaaaagagcaaagaguccauaaaacagaccuggaacgaguguuagaagcaaaugauggcucaggaauguuagacgaagaugaggaggauuugcagagggcucuggcacuaagucgccaagaaauugacauggaagaugaggaagcagaucuccgcagggcuauucagcuaaguaugcaagguaguuccagaaacauaucucaagauaugacacagacaucagguacaaaucuuacuucagaagagcuucggaagagacgagaagccuacuuugaaaaacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 278 - RNA, 6142 nt, Homo_Sapiens
gagaggggcagggggcggagcuggagggggugguucggcgugggggccguuggcuccagacaaauaaacauggaguccaucuuccacgagaaaaaaugaaagaucauuuauaugcaauuauaaggaacacugguuuacaguuagaaaauuaggaaaacagacagcagcaaaagcagcaacagcagcagcagcagcagcagcagggggaccuaucaggacagaguucacauccaugugaaaggccagccaccaguucaggagcacuugggagugaucuaggugaugcuaugagugaagaagacaugcuucaggcagcugugaccaugucuuuagaaacugucagaaaugauuugaaaacagaaggaaaaaaauaauaccuuuaaaaaauaauuuagauauucauacuuuccaacauuauccugugugauuacagcauaggguccacuuugguaaugugucaaagagaugaggaaauaagacuuuuagcgguuugcaaacaaaaugaugggaaaguggaacaaugcgucgguuguaggacuaaauaaugaucuuccaaauauuagccaaagaggcauucagcaauuaaagacauuuaaaauaguuuucuaaauguuucuuuuucuuuuuugagugugcaauauguaacaugucuaaaguuagggcauuuuucuuggaucuuuuugcagacuagcuaauuagcucucgccucaggcuuuuuccauauaguuuguuuucuuuuucugucuuguagguaaguuggcucacaucauguaauaguggcuuucauuucuuauuaaccaaauuaaccuuucaggaaaguaucucuacuuuccugauguugauaauaguaaugguucuagaaggaugaacaguucucccuucaacuguauaccgugugcuccaguguuuucuuguguuguuuucucugaucacaacuuuucugcuaccugguuuucauuauuuucccacaauucuuuugaaagaugguaaucuuuucugagguuuagcguuuuaagcccuacgaugggaucauuauuucaugacuggugcguuccuaaacucugaaaucagccuugcacaaguacuugagaauaaaugagcauuuuuuaaaaugugugagcaugugcuuucccagaugcuuuaugaaugucuuuucacuuauaucaaaaccuuacagcuuuguugcaaccccuucuuccugcgccuuauuuuuuccuuucuucuccaauugagaaaacuaggagaagcauaguaugcaggcaagucuccuucuguuagaagacuaaacauacguacccaccaugaauguaugauacaugaaauuuggccuucaauuuuaauagcaguuuuauuuuauuuuuucuccuaugacuggagcuuuguguucucuuuacaguugagucauggaauguaggugucugcuucacaucuuuuaguagguauagcuugucaaagauggugaucuggaacaugaaaauaauuuacuaaugaaaauauguuuaaauuuauacugugauuugacacuugcaucauguuuagauagcuuaagaacaauggaagucacaguacuuaguggaucuauaaauaagaaaguccauaguuuugauaaauauucucuuuaauugagauguacagagaguuucuugcugggucaauaggauaguaucauuuuggugaaaaccaugucucugaaauugauguuuuaguuucaguguucccuaucccucauucuccaucuccuuuugaagcucuuuugaauguugaauuguucauaagcuaaaauccaagaaauuucagcugacaacuucgaaaauuauaauaugguauauugcccuccugguguguggcugcacacauuuuaucagggaaaguuuuuugaucuaggauuuauugcuaacuaacugaaaagagaagaaaaaauaucuuuuauuuaugauuauaaaauagcuuuuucuucgauauaacagauuuuuuaagucauuauuuugugccaaucaguuuucugaaguuucccuuacacaaaaggauagcuuuauuuuaaaaucuaaaguuucuuuuaauaguuaaaaauguuucagaagaauuauaaaacuuuaaaacugcaagggauguuggaguuuaguacuacucccucaagauuuaaaaagcuaaauauuuuaagacugaacauuuauguuaauuauuaccaguguguuugucauauuuuccauggauauuuguucauuaccuuuuuccauugaaaaguuacauuaaacuuuucauacacuugaauugaugagcuaccuaauauaaaaaugagaaaaccaauaugcauuuuaaaguuuuaacuuuagaguuuauaaaguucauauauacccuaguuaaagcacuuaagaaaauauggcauguuugacuuuuaguuccuagagaguuuuuguuuuuguuuuuguuuuuuuuugagacggagucuugcuaugucucccaggcuggagggcaguggcaugaucucggcucacuacaacuuccaccucccggguucaagcaauucuccugccucagccuccagaguagcugggauuacaggcgcccaccaccacacccggcagauuuuuguauuuuugguagagacgcgguuucaucauguuuggccaggcuggucucgaacuccugaccucaggugauccgccugccuuggccucccaaaguguugggauuacaggcaugagccacugcgccuggccagcuagagaguuuuuaaagcagagcugagcacacacuggaugcguuugaauguguuuguguaguuuguugugaaauuguuacauuuagcaggcagauccagaagcacuagugaacugucaucuuggugggguuggcuuaaauuuaauugacuguuuagauuccauuucuuaauugauuggccaguaugaaaagaugccagugcaaguaaccauaguaucaaaaaaguuaaaaauuauucaaagcuauaguuuauacaucagguacugccauuuacuguaaaccaccugcaagaaagucaggaacaacuaaauucacaagaacuguccugcuaagaaguguauuaaagauuuccauuuuguuuuacuaauugggaacaucuuaauguuuaauauuuaaacuauugguaucauuuuucuaauguauaauuuguauuacugggaucaaguauguacaguggugaugcuaguagaaguuuaagccuuggaaauaccacuuucauauuuucagaugucauggauuuaaugaguaauuuauguuuuuaaaauucagaauaguuaaucucugaucuaaaaccaucaaucuauguuuuuuacgguaaucauguaaauauuucaguaauauaaacuguuugaaaaggcugcugcagguaaacucuauacuaggaucuuggccaaauaauuuacaauucacagaauauuuuauuuaagguggugcuuuuuuuuuuuguccuuaaaacuugauuuuucuuaacuuuauucaugaugccaaaguaaaugaggaaaaaaacucaaaaccaguugaguaucauugcagacaaaacuaccaguaguccauauuguuuaauauuaaguugaauaaaauaaauuuuauuucagucagagccuaaaucacauuuugauugucugaauuuuugauacuauuuuuaaaaucaugcuaguggcggcugggcgugguagcucacgccuguaaucccagcauuuugggaggccgaaguggguggaucacgaggucgggaguucgagaccagcuuggccaaaauggugaaaccccaucuguacuaaaaacuacaaaaauuagcugggcgcgguggcaggugccuguaaucccagcuaccugggagucugaggcaggagaauugcuugaacccuggcgacagaggaugcagugagccaagauggugccacuguacuccagacugggcgacagagugagacucugucucaaaaaaaaaaaaaaaaucaugcuagugccaagagcuacuaaauucuuaaaaccggcccauuggaccuguacagauaaaaaauagauucagugcauaaucaaaauaugauaauuuuaaaaucuuaaguagaaaaauaaaucuugauguuuuaaauucuuacgaggauucaauaguuaauauugaugaucucccggcugggugcaguggcucacgccuguaaucccagcaguucuggaggcugaggugggcgaaucacuucaggccaggaguucaagaccagucugggcaacauggugaaaccucguuucuacuaaaaauacaaaaauuagccgggcgugguugcacacacuuguaaucccagcuacucaggaggcuaagaaucgcaugagccuaggaggcagagguugcagagugccaagggcucaccacugcauuccagccugcccaacagagugagacacuguuucugaaaaaaaaaaauauauauauauauauauauauguguguauauauauauguauauauauaugacuuccuauuaaaaacuuuaucccagucgggggcaguggcucacgccuguaaucccaacacuuugggaggcugaggcagguggaucaccugaaguccggaguuugagaccagccuggccaacauggugaaaccccaucucuacuaaaaauacaaaacuuaagccagguaugguggcgggcaccuguaaucccaguuacuugggaggcugaggcaggagaaucguuuaaacccaggagguggagguugcagugagcugagaucgugccauugcacucuagccugggcaacaagaguaaaacuccaucuuaaagguuuguuuguuuuuuuuuaauccggaaacgaagaggcguugggccgcuauuuucuuuuucuuucuuucuuucuuucuuuuuuuuuuuuucugagacggagucuagcucugcugcccaggcuggaguacaaugacacgauguuggcucacugcaaccuccaccuccuggguucaagcgauucuccugccucagccucccaaguaccugggauuacaggcaccugccacuacaccuggcgaauauuuguuuuuuuuaguagagacgggcuuuuaccauguuaggcuggucucaaacuccugaccucaggugaucugccugccuuggccucccaaagugcugggauuacaggugcaggccaccacacccggccuugggccacuguuuucaaagugaauuguuuguuguaucgaguccuuaaguauggauauauaugugacccuaauuaagaacuaccagauuggaucaacuaaucaugucagcaauguaaauaacuuuauuuuucauauucaaaauaaaaacuuucuuuuauuucuggccccuuuauaaccagcaucuuuuugcuuuaaaaaaugaccuggcuuuguauuuuuuuagucuuaaacauaauaaaaauauuuuuguucuaauuugcuuucaugagugaagauuauugacaucguugguaaauucuagaauuuugauuuuguuuuuuaauuugaagaaaaucuuugcuauuauuauuuuuuccaaguggucuggcauuuuaagaauuagugcuaauaacguaacuucuaaauuugucguaauuggcauguuuaauagcauaucaaaaaacauuuuaagccuguggauucauagacaaagcaaugagaaacauuaguaaaauauaaauggauauuccugaugcauuuaggaagcucucaauugucucuugcauaguucaaggaauguuuucugaauuuuuuuaaugcuuuuuuuuuuuuugaaagaggaaaacauacauuuuuaaaugugauuaucuaauuuuuacaacacugggcuauuaggaauaacuuuuuaaaaauuacuguucuguauaaauauuugaaauucaaguacagaaaauaucugaaacaaaaagcauuguuguuuggccaugauacaagugcacuguggcagugccgcuugcucaggacccagcccugcagcccuucugugugugcucccucguuaaguucauuugcuguuauuacacacacaggccuuccugucuggucguuagaaaagccgggcuuccaaagcacuguugaacacaggauucuguuguuaguguggauguucaaugaguuguauuuuaaauaucaaagauuauuaaauaaagauaauguuugcuuuucua

SEQ ID NO: 279 - RNA, 10636 nt, Homo_Sapiens
gaggagagagcagaguauaccgcagacaucauuucuacuacaguggcggagccguacaggaccuguuucacugcagggggauccaaaacaagccccguggagcagcagccagagcaacagcagccgcaagacauuguuucucucccucugcccccccuuccccacgcaaccccagauccauuuacacuuuacaguuuuaccucacaaaaacuacuacaagcaccaagcucccugauggaaaggagcaucgugcaucaagucaccagggugguccauucaagcugcagauuuguuugucauccuuguacagcaaucuccuccuccacugccacuacagggaagugcaucacaugucagcauacuggagcauagugaaagagucuauuuugaagcuucaaacuuagugcugcugcagaccaggaacaagagagaaagaguggauuucagccugcacggauggucuugaaacacaaaugguuuuuggucuaggcguuuuacacugagauucuccacugccacccuuucuacucaagcaaaaucuucgugaaaagaucugcugcaaggaacugauagcuuaugguucuccauugugaugaaagcacaugguacaguuuuccaaagaaauuagaccauuuucuucgugagaaagaaaucgacgugcuguuuucauaggguauuucucacuucucugugaaaggaagaaagaacacgccugagcccaagagcccucaggagcccuccagagccugugggaagucuccauggugaaguauaggcugaggcuaccugugaacaguacgcagugaauguucauccagagcugcuguuggcggauuguacccacggggagaugauuccucaugaagagccuggauccccuacagaaaucaaaugugacuuuccguuuaucagacuaaaaucagagccauccagacagugaaacagucaccguggaggggggacggcgaaaaaugaaauccaaccaagagcggagcaacgaaugccugccucccaagaagcgcgagauccccgccaccagccgguccuccgaggagaaggccccuacccugcccagcgacaaccaccggguggagggcacagcauggcucccgggcaacccugguggccggggccacgggggcgggaggcaugggccggcagggaccucgguggagcuugguuuacaacagggaauagguuuacacaaagcauuguccacagggcuggacuacuccccgcccagcgcucccaggucuguccccguggccaccacgcugccugccgcguacgccaccccgcagccagggaccccggugucccccgugcaguacgcucaccugccgcacaccuuccaguucauuggguccucccaauacaguggaaccuaugccagcuucaucccaucacagcugauccccccaaccgccaaccccgucaccagugcaguggccucggccgcaggggccaccacuccaucccagcgcucccagcuggaggccuauuccacucugcuggccaacaugggcagucugagccagacgccgggacacaaggcugagcagcagcagcagcagcagcagcagcagcagcagcagcaucagcaucagcagcagcagcagcagcagcagcagcagcagcagcagcagcaccucagcagggcuccggggcucaucaccccggggucccccccaccagcccagcagaaccaguacguccacauuuccaguucuccgcagaacaccggccgcaccgccucuccuccggccauccccguccaccuccacccccaccagacgaugaucccacacacgcucacccuggggccccccucccaggucgucaugcaauacgccgacuccggcagccacuuugucccucgggaggccaccaagaaagcugagagcagccggcugcagcaggccauccaggccaaggagguccugaacggugagauggagaagagccggcgguacggggccccguccucagccgaccugggccugggcaaggcaggcggcaagucgguuccucacccguacgaguccaggcacguggugguccacccgagccccucagacuacagcagucgugauccuucggggguccgggccucugugaugguccugcccaacagcaacacgcccgcagcugaccuggaggugcaacaggccacucaucgugaagccuccccuucuacccucaacgacaaaaguggccugcauuuagggaagccuggccaccgguccuacgcgcucucaccccacacggucauucagaccacacacagugcuucagagccacucccggugggacugccagccacggccuucuacgcagggacucaacccccugucaucggcuaccugagcggccagcagcaagcaaucaccuacgccggcagccugccccagcaccuggugauccccggcacacagccccugcucaucccggucggcagcacugacauggaagcgucgggggcagccccggccauagucacgucauccccccaguuugcugcagugccucacacguucgucaccaccgcccuucccaagagcgagaacuucaacccugaggcccuggucacccaggccgccuacccagccauggugcaggcccagauccaccugccuguggugcaguccguggccuccccggcggcggcucccccuacgcugccucccuacuucaugaaaggcuccaucauccaguuggccaacggggagcuaaagaagguggaagacuuaaaaacagaagauuucauccagagugcagagauaagcaacgaccugaagaucgacuccagcaccguagagaggauugaagacagccauagcccgggcguggccgugauacaguucgccgucggggagcaccgagcccaggucagcguugaaguuuugguagaguauccuuuuuuuguguuuggacagggcuggucauccugcuguccggagagaaccagccagcucuuugauuugccguguuccaaacucucaguuggggaugucugcaucucgcuuacccucaagaaccugaagaacggcucuguuaaaaagggccagcccguggaucccgccagcguccugcugaagcacucaaaggccgacggccuggcgggcagcagacacagguaugccgagcaggaaaacggaaucaaccaggggagugcccagaugcucucugagaauggcgaacugaaguuuccagagaaaaugggauugccugcagcgcccuuccucaccaaaauagaacccagcaagcccgcggcaacgaggaagaggagguggucggcgccagagagccgcaaacuggagaagucagaagacgaaccaccuuugacucuuccuaagccuucucuaauuccucaggagguuaagauuugcauugaaggccggucuaauguaggcaaguagaggcagcgugggggaaaggaaacguggcucucccuuaucauuuguauccagauuacuguacuguaggcuaaaauaacacaguauuuacauguuaucuucuuaauuuuagguuucuguucuaaccuugucauuagaguuacagcaggugugucgcaggagacuggugcauaugcuuuuuccacgagugucugucagugagcgggcgggaggaagggcacagcaggagcggucagggcuccaggcauccccggggaagaaaggaacggggcuucacagugccugccuucucuagcggcacagaagcagccgggggcgcugacucccgcuagugucaggagaaaagucccgugggaaggguccugcaggggugcaggguugcacgcaugugggggugcacaggcgcuguggcggcgagugagggucucuuuuucucugccucccucugccucacucucuugcuaucggcaugggccggggggguucagagcaguguccuccugggguucccacgugcaaaaucaacaucaggaacccagcuucagggcaucgcggagacgcgucagauggcagauuuggaaaguuaaccauuuaaaagaacauuuuucucuccaacauauuuuacaauaaaagcaacuuuuaauuguauagauauauauuucccccuauggggccugacugcacugauauauauuuuuuuuaaagagcaacugccacaugcgggauuucauuucugcuuuuuacuagugcagcgaugucaccaggguguugugguggacagggaagccccugcugucauggccccacaugggguaagggggguugggggugggggagagggagagagcgaacacccacgcugguuucugugcaguguuaggaaaaccaaucagguuauugcauugacuucacucccaagagguagaugcaaacugcccuucagugagagcaacagaagcucuucacguugaguuugcgaaaucuuuuugucuuugaacucuaguacuguuuauaguucaugacuauggacaacucgggugccacuuuuuuuuuuuuucagauuccagugugacaugaggaauuagauuuugaagaugagcauauauuacuaucuuuaagcauuuaaaaauacuguucacacuuuauuaccaagcaucuuggucucucauucaacaaguacuguaucucacuuuaaacucuuuggggaaaaaacaaaaacaaaaaaaacuaaguugcuuucuuuuuuucaacacuguaacuacauuucagcucugcagaauugcugaagagcaagauauugaaaguuucaaugugguuuaaagggaugaaugugaauuaugaacuaguaugugacaauaaaugaccaccaaguacuaccugacgggaggcacuuuucacuuugaugucugagaaucaguucaaggcauaugcagaguuggcagagaaacugagagaaaagggauggagaagagaauacucauuuuuguccaguguuuuucuuuuuaagaugaacuuuuaaagaaccuugcgauuugcacauauugaguuuauaacuugugugauauuccugcaguuuuuauccaauaacauugugggaaagguuugggggacugaacgagcauaaauaaauguagcaaaauuucuuucuaaccugccuaaacucuaggccauuuuauaagguuauguuccuuugaaaauucauuuuggucuuuuuaccacaucugucacaaaaagccaggucuuagcgggcucuuagaaacucugagaauuuucuucagauucauugagagaguuuuccauaaagacauuuauauaugugagcaagauuuuuuuuaaacaauuacuuuauuauuguuguuauuaauguuauuuucagaauggcuuuuuuuuuucuauucaaaaucaaaucgagauuuaauguuugguacaaacccagaaaggguauuucauaguuuuuaaaccuuucauucccagagauccgaaauaucauuuguggguuuugaaugcaucuuuaaagugcuuuaaaaaaaaguuuuauaaguagggagaaauuuuuaaauauucuuacuuggauggcugcaacuaaacugaacaaauaccugacuuuucuuuuaccccauugaaaauaguacuuucuucguuucacaaauuaaaaaaaaaaucugguaucaacccacauuuuggcugucuaguauucauuuacauuuaggguucaccaggacuaaugauuuuuauaaaccguuuucugggguguaccaaaaacauuugaauagguuuagaauagcuagaauaguuccuugacuuuccucgaauuucauuacccucucagcaugcuugcagagagcugggugggcucauucuugcagucauacugcuuauuuagugcuguauuuuuuaaacguuucuguucagagaacuugcuuaaucuuccauauauucugcucagggcacuugcaauuauuagguuuuguuuuucuuuuuguuuuuuagccuuugaugguaagaggaauacgggcugccacauagacuuuguucucauuaauaucacuauuuacaacucauguggacucagaaaaacacacaccaccuuuuggcuuacuucgaguauugaauugacuggauccacuaaaccaacacuaagaugggaaaacacacaugguuuggagcaauaggaacaucaucauaauuuuugugguucuauuucagguauaggaauuauaaaauaauugguucuuucuaaacacuugucccauuucauucucuugcuuuuuuagcaugugcaauacuuucugugccaauagagucugaccagugugcuauauaguuaaagcucauucccuuuuggcuuuuuccuuguuugguugaucuuccccauucuggccagagcagggcuggagggaaggagccaggagggagagagccucccaccuuuccccugcugcggaugcugagugcuggggcggggagccuucaggagccccgugcgucugccgccacguugcagaaagagccagccaaggagacccgggggaggaaccgcaguguccccugucaccacacggaauagugaauguggaguguggagaggaaggaggcagauucauuucuaagacgcacucuggagccauguagccuggagucaacccauuuuccacggucuuuucugcaagugggcaggccccuccucggggucuguguccuugagacuuggagcccugccucugagccuggacgggaaguguggccuguugugugugugcguucugagcguguuggccaguggcuguggaggggaccaccugccacccacggucaccacucccuuguggcagcuuucucuucaaauaggaagaacgcacagagggcaggagccuccuguuugcagacguuggcgggccccgaggcucccagagcagccucugucaccgcuucuguguagcaaacauuaacgaugacagggguagaaauucuucggugccguucagcuuacaaggaucagccaugugccucuguacuauguccacuuugcaauauuuaccgacagccgucuuuuguucuuucuuuccuguuuuccauuuuuaaacuaguaacagcaggccuuuugcguuuacaauggaacacaaucaccaagaaauuagucagggcgaaaagaaaaaaauaauacuauuaauaagaaaccaacaaacaagaaccucucuuucuagggauuucuaaauauauaaaaugacuguuccuuagaauguuuaacuuaagaauuauuucaguuugucugggccacacuggggcagaggggggagggagggauacagagauggaugccacuuaccucagaucuuuuaaaguggaaauccaaauugaauuuucauuuggacuuucaggauaauuuucuauguuggucaacuuuucguuuucccuaacucacccaguuuaguuugggaugauuugauuucuguuguuguugaucccauuucuaacuuggaauugugagccucuauguuuucuguuaggugaguguguuggguuuuuuccccccaccaggaaguggcagcaucccuccuucuccccuaaagggacucugcggaaccuuucacaccucuuucucagggacggggcaggugugugugugguacacugacguguccagaagcagcacuuugacugcucuggaguaggguuguacaauuucaaggaauguuuggauuuccugcaucuuguggauuacuccuuagauaccgcauagauugcaauauaaugcugcauguucaagaugaacaguagcuccuaguaaucauaaaauccacucuuugcacaguuugaucuuuacugaaauauguugccaaaauuuauuuuuguuguuguagcucuggauuuuguuuuguuuuguuuuuuaaggaaacgauugacaauacccuuuaacaucugugacuacuaaggaaaccuauuucuuucauagagagaaaaaucuccaaugcuuuugaagacacuaauaccgugcuauuucagauaugggugaggaagcagagcucucgguaccgaaggccgggcuucuugagcuguguugguugucauggcuacuguuucaugaaccacaagcagcucaacagacuggucuguugccuucugaaacccuuugcacuucaauuugcaccaggugaaaacagggccagcagacuccauggcccaauucgguuucuucgguggugaugugaaaggagagaauuacacuuuuuuuuuuuuuaaguggcguggaggccuuugcuuccacauuuguuuuuaacccagaauuucugaaauagagaauuuaagaacacaucaaguaauaaauauacagagaauauacuuuuuuauaaagcacaugcaucugcuauuguguuggguugguuuccucucuuuuccacggacaguguuguguuucuggcauagggaaacuccaaacaacuugcacaccucuacuccggagcugagauuucuuuuacauagaugaccucgcuucaaauacguuaccuuacugaugauaggaucuuuucuuguagcacuauaccuugugggaauuuuuuuuuaaauguacaccugauuugagaagcugaagaaaacaaaauuuugaagcacucacuuugaggaguacagguaauguuuuaaaaaauugcacaaaagaaaaaugaaugucgaaaugauucauucaguguuugaaagauauggcucuguugaaacaaugaguuucauacuuuguuuguaaaaaaaaaaaagcagagaaggguugaaaguuacauguuuuuuuguauauagaaauuugucaugucuaaaugaucagauuuguaugguuauggccuggaagaauuacuacguaaaaggcucuuaaacuauaccuaugcuuauuguuauuuuuguuacauauagcccucgucugagggaggggaacucgguauucugcgauuugagaauacuguucauuccuaugcugaaaguacuucucugagcucccuucuuagucuaaacucuuaagccauugcaacuucuuuuucuucagagaugauguuugacauuuucagcacuuccuguuccuauaaacccaaagaauauaaucuugaacacgaaguguuuguaacaagggauccaggcuaccaaucaaacaggacucauuauggggacaaaaaaaaaaauuauuucaccuucuuuccccccacaccucauuuaaauggggggaguaaaaacaugauuucaauguaaaugccucauuuuauuuuaguuuuauuuugauuuuuauuuaauauaaagaggccagaauaaauacggagcaucuucucagaauaguauuccuguccaaaaaucaagccggacaguggaaacuggacagcuguggggauauuaagcacccccacuuacaauucuuaaauucagaaucucguccccucccuucucguugaaggcaacuguucugguagcuaacuuucuccuguguaauggcgggagggaacaccggcuucaguuuuucauguccccaugacuugcauacaaaugguucaacuguauuaaaauuaagugcauuuggccaauagguaguaucuauacaauaacaacaaucucuaagaauuuccauaacuuuucuuaucugaaaggacucaagucuuccacugcagauacauuggaggcuucacccacguuuucuuucccuuuaguuuguuugcugucuggauggccaaugagccugucuccuuuucuguggccaaucugaaggccuucguuggaaguguuguuuacaguaauccuuaccaagauaacauacuguccuccagaauaccaaguauuaggugacacuagcucaagcuguugucuucagagcaguuaccaagaagcucggugcacagguuuucucugguucuuacaggaaccaccuacucuuucaguuuucuggcccaggagugggguaaauccuuuaguuagugcauuugaacuugauaccugugcauucaguucugugaauacugcccuuuuuggcgggguuuccucaucuccccagccugaacugcucaacucuaaacccaaauuagugucagccgaaaggagguuucaagauaguccugucaguauuuguggugaccuucagauuagacagucuucauuuccagccaguggaguccuggcuccagagccaucucugagacucguacuacuggauguuuuaauaucagaucauuacccaccauaugccucccacaggccaagggaaaacagacaccagaacuuggguugagggcacuaccagacugacauggccaguacagaggagaacuagggaaggaaugauguuuugcaccuuauugaaaagaaaauuuuaagugcauacauaauaguuaagagcuuuuauugugacaggagaacuuuuuuccauaugcgugcauacucucuguaauuccaguguaaaauauuguacuugcacuagcuuuuuuaaacaaauauuaaaaaauggaagaauucauauucuauuuucuaaucguggugugucuauuuguaggauacacucgagucuguuuauugaauuuuauggucccuuucuuugauggugcuugcagguuuucuagguagaaauuauuucauuauuauaauaaaacaauguuugauucaaaauuugaacaaaauuguuuuaaauaaauugucuguauaccaguacaaguuuauuguuucaguauacucguacuaauaaaauaacagugccaauugca

SEQ ID NO: 280 - RNA, 10587 nt, Homo_Sapiens
gaggagagagcagaguauaccgcagacaucauuucuacuacaguggcggagccguacaggaccuguuucacugcagggggauccaaaacaagccccguggagcagcagccagagcaacagcagccgcaagacauuguuucucucccucugcccccccuuccccacgcaaccccagauccauuuacacuuuacagagcaucgugcaucaagucaccagggugguccauucaagcugcagauuuguuugucauccuuguacagcaaucuccuccuccacugccacuacagggaagugcaucacaugucagcauacuggagcauagugaaagagucuauuuugaagcuucaaacuuagugcugcugcagaccaggaacaagagagaaagaguggauuucagccugcacggauggucuugaaacacaaaugguuuuuggucuaggcguuuuacacugagauucuccacugccacccuuucuacucaagcaaaaucuucgugaaaagaucugcugcaaggaacugauagcuuaugguucuccauugugaugaaagcacaugguacaguuuuccaaagaaauuagaccauuuucuucgugagaaagaaaucgacgugcuguuuucauaggguauuucucacuucucugugaaaggaagaaagaacacgccugagcccaagagcccucaggagcccuccagagccugugggaagucuccauggugaaguauaggcugaggcuaccugugaacaguacgcagugaauguucauccagagcugcuguuggcggauuguacccacggggagaugauuccucaugaagagccuggauccccuacagaaaucaaaugugacuuuccguuuaucagacuaaaaucagagccauccagacagugaaacagucaccguggaggggggacggcgaaaaaugaaauccaaccaagagcggagcaacgaaugccugccucccaagaagcgcgagauccccgccaccagccgguccuccgaggagaaggccccuacccugcccagcgacaaccaccggguggagggcacagcauggcucccgggcaacccugguggccggggccacgggggcgggaggcaugggccggcagggaccucgguggagcuugguuuacaacagggaauagguuuacacaaagcauuguccacagggcuggacuacuccccgcccagcgcucccaggucuguccccguggccaccacgcugccugccgcguacgccaccccgcagccagggaccccggugucccccgugcaguacgcucaccugccgcacaccuuccaguucauuggguccucccaauacaguggaaccuaugccagcuucaucccaucacagcugauccccccaaccgccaaccccgucaccagugcaguggccucggccgcaggggccaccacuccaucccagcgcucccagcuggaggccuauuccacucugcuggccaacaugggcagucugagccagacgccgggacacaaggcugagcagcagcagcagcagcagcagcagcagcagcagcagcaucagcaucagcagcagcagcagcagcagcagcagcagcagcagcagcagcaccucagcagggcuccggggcucaucaccccggggucccccccaccagcccagcagaaccaguacguccacauuuccaguucuccgcagaacaccggccgcaccgccucuccuccggccauccccguccaccuccacccccaccagacgaugaucccacacacgcucacccuggggccccccucccaggucgucaugcaauacgccgacuccggcagccacuuugucccucgggaggccaccaagaaagcugagagcagccggcugcagcaggccauccaggccaaggagguccugaacggugagauggagaagagccggcgguacggggccccguccucagccgaccugggccugggcaaggcaggcggcaagucgguuccucacccguacgaguccaggcacguggugguccacccgagccccucagacuacagcagucgugauccuucggggguccgggccucugugaugguccugcccaacagcaacacgcccgcagcugaccuggaggugcaacaggccacucaucgugaagccuccccuucuacccucaacgacaaaaguggccugcauuuagggaagccuggccaccgguccuacgcgcucucaccccacacggucauucagaccacacacagugcuucagagccacucccggugggacugccagccacggccuucuacgcagggacucaacccccugucaucggcuaccugagcggccagcagcaagcaaucaccuacgccggcagccugccccagcaccuggugauccccggcacacagccccugcucaucccggucggcagcacugacauggaagcgucgggggcagccccggccauagucacgucauccccccaguuugcugcagugccucacacguucgucaccaccgcccuucccaagagcgagaacuucaacccugaggcccuggucacccaggccgccuacccagccauggugcaggcccagauccaccugccuguggugcaguccguggccuccccggcggcggcucccccuacgcugccucccuacuucaugaaaggcuccaucauccaguuggccaacggggagcuaaagaagguggaagacuuaaaaacagaagauuucauccagagugcagagauaagcaacgaccugaagaucgacuccagcaccguagagaggauugaagacagccauagcccgggcguggccgugauacaguucgccgucggggagcaccgagcccaggucagcguugaaguuuugguagaguauccuuuuuuuguguuuggacagggcuggucauccugcuguccggagagaaccagccagcucuuugauuugccguguuccaaacucucaguuggggaugucugcaucucgcuuacccucaagaaccugaagaacggcucuguuaaaaagggccagcccguggaucccgccagcguccugcugaagcacucaaaggccgacggccuggcgggcagcagacacagguaugccgagcaggaaaacggaaucaaccaggggagugcccagaugcucucugagaauggcgaacugaaguuuccagagaaaaugggauugccugcagcgcccuuccucaccaaaauagaacccagcaagcccgcggcaacgaggaagaggagguggucggcgccagagagccgcaaacuggagaagucagaagacgaaccaccuuugacucuuccuaagccuucucuaauuccucaggagguuaagauuugcauugaaggccggucuaauguaggcaaguagaggcagcgugggggaaaggaaacguggcucucccuuaucauuuguauccagauuacuguacuguaggcuaaaauaacacaguauuuacauguuaucuucuuaauuuuagguuucuguucuaaccuugucauuagaguuacagcaggugugucgcaggagacuggugcauaugcuuuuuccacgagugucugucagugagcgggcgggaggaagggcacagcaggagcggucagggcuccaggcauccccggggaagaaaggaacggggcuucacagugccugccuucucuagcggcacagaagcagccgggggcgcugacucccgcuagugucaggagaaaagucccgugggaaggguccugcaggggugcaggguugcacgcaugugggggugcacaggcgcuguggcggcgagugagggucucuuuuucucugccucccucugccucacucucuugcuaucggcaugggccggggggguucagagcaguguccuccugggguucccacgugcaaaaucaacaucaggaacccagcuucagggcaucgcggagacgcgucagauggcagauuuggaaaguuaaccauuuaaaagaacauuuuucucuccaacauauuuuacaauaaaagcaacuuuuaauuguauagauauauauuucccccuauggggccugacugcacugauauauauuuuuuuuaaagagcaacugccacaugcgggauuucauuucugcuuuuuacuagugcagcgaugucaccaggguguugugguggacagggaagccccugcugucauggccccacaugggguaagggggguugggggugggggagagggagagagcgaacacccacgcugguuucugugcaguguuaggaaaaccaaucagguuauugcauugacuucacucccaagagguagaugcaaacugcccuucagugagagcaacagaagcucuucacguugaguuugcgaaaucuuuuugucuuugaacucuaguacuguuuauaguucaugacuauggacaacucgggugccacuuuuuuuuuuuuucagauuccagugugacaugaggaauuagauuuugaagaugagcauauauuacuaucuuuaagcauuuaaaaauacuguucacacuuuauuaccaagcaucuuggucucucauucaacaaguacuguaucucacuuuaaacucuuuggggaaaaaacaaaaacaaaaaaaacuaaguugcuuucuuuuuuucaacacuguaacuacauuucagcucugcagaauugcugaagagcaagauauugaaaguuucaaugugguuuaaagggaugaaugugaauuaugaacuaguaugugacaauaaaugaccaccaaguacuaccugacgggaggcacuuuucacuuugaugucugagaaucaguucaaggcauaugcagaguuggcagagaaacugagagaaaagggauggagaagagaauacucauuuuuguccaguguuuuucuuuuuaagaugaacuuuuaaagaaccuugcgauuugcacauauugaguuuauaacuugugugauauuccugcaguuuuuauccaauaacauugugggaaagguuugggggacugaacgagcauaaauaaauguagcaaaauuucuuucuaaccugccuaaacucuaggccauuuuauaagguuauguuccuuugaaaauucauuuuggucuuuuuaccacaucugucacaaaaagccaggucuuagcgggcucuuagaaacucugagaauuuucuucagauucauugagagaguuuuccauaaagacauuuauauaugugagcaagauuuuuuuuaaacaauuacuuuauuauuguuguuauuaauguuauuuucagaauggcuuuuuuuuuucuauucaaaaucaaaucgagauuuaauguuugguacaaacccagaaaggguauuucauaguuuuuaaaccuuucauucccagagauccgaaauaucauuuguggguuuugaaugcaucuuuaaagugcuuuaaaaaaaaguuuuauaaguagggagaaauuuuuaaauauucuuacuuggauggcugcaacuaaacugaacaaauaccugacuuuucuuuuaccccauugaaaauaguacuuucuucguuucacaaauuaaaaaaaaaaucugguaucaacccacauuuuggcugucuaguauucauuuacauuuaggguucaccaggacuaaugauuuuuauaaaccguuuucugggguguaccaaaaacauuugaauagguuuagaauagcuagaauaguuccuugacuuuccucgaauuucauuacccucucagcaugcuugcagagagcugggugggcucauucuugcagucauacugcuuauuuagugcuguauuuuuuaaacguuucuguucagagaacuugcuuaaucuuccauauauucugcucagggcacuugcaauuauuagguuuuguuuuucuuuuuguuuuuuagccuuugaugguaagaggaauacgggcugccacauagacuuuguucucauuaauaucacuauuuacaacucauguggacucagaaaaacacacaccaccuuuuggcuuacuucgaguauugaauugacuggauccacuaaaccaacacuaagaugggaaaacacacaugguuuggagcaauaggaacaucaucauaauuuuugugguucuauuucagguauaggaauuauaaaauaauugguucuuucuaaacacuugucccauuucauucucuugcuuuuuuagcaugugcaauacuuucugugccaauagagucugaccagugugcuauauaguuaaagcucauucccuuuuggcuuuuuccuuguuugguugaucuuccccauucuggccagagcagggcuggagggaaggagccaggagggagagagccucccaccuuuccccugcugcggaugcugagugcuggggcggggagccuucaggagccccgugcgucugccgccacguugcagaaagagccagccaaggagacccgggggaggaaccgcaguguccccugucaccacacggaauagugaauguggaguguggagaggaaggaggcagauucauuucuaagacgcacucuggagccauguagccuggagucaacccauuuuccacggucuuuucugcaagugggcaggccccuccucggggucuguguccuugagacuuggagcccugccucugagccuggacgggaaguguggccuguugugugugugcguucugagcguguuggccaguggcuguggaggggaccaccugccacccacggucaccacucccuuguggcagcuuucucuucaaauaggaagaacgcacagagggcaggagccuccuguuugcagacguuggcgggccccgaggcucccagagcagccucugucaccgcuucuguguagcaaacauuaacgaugacagggguagaaauucuucggugccguucagcuuacaaggaucagccaugugccucuguacuauguccacuuugcaauauuuaccgacagccgucuuuuguucuuucuuuccuguuuuccauuuuuaaacuaguaacagcaggccuuuugcguuuacaauggaacacaaucaccaagaaauuagucagggcgaaaagaaaaaaauaauacuauuaauaagaaaccaacaaacaagaaccucucuuucuagggauuucuaaauauauaaaaugacuguuccuuagaauguuuaacuuaagaauuauuucaguuugucugggccacacuggggcagaggggggagggagggauacagagauggaugccacuuaccucagaucuuuuaaaguggaaauccaaauugaauuuucauuuggacuuucaggauaauuuucuauguuggucaacuuuucguuuucccuaacucacccaguuuaguuugggaugauuugauuucuguuguuguugaucccauuucuaacuuggaauugugagccucuauguuuucuguuaggugaguguguuggguuuuuuccccccaccaggaaguggcagcaucccuccuucuccccuaaagggacucugcggaaccuuucacaccucuuucucagggacggggcaggugugugugugguacacugacguguccagaagcagcacuuugacugcucuggaguaggguuguacaauuucaaggaauguuuggauuuccugcaucuuguggauuacuccuuagauaccgcauagauugcaauauaaugcugcauguucaagaugaacaguagcuccuaguaaucauaaaauccacucuuugcacaguuugaucuuuacugaaauauguugccaaaauuuauuuuuguuguuguagcucuggauuuuguuuuguuuuguuuuuuaaggaaacgauugacaauacccuuuaacaucugugacuacuaaggaaaccuauuucuuucauagagagaaaaaucuccaaugcuuuugaagacacuaauaccgugcuauuucagauaugggugaggaagcagagcucucgguaccgaaggccgggcuucuugagcuguguugguugucauggcuacuguuucaugaaccacaagcagcucaacagacuggucuguugccuucugaaacccuuugcacuucaauuugcaccaggugaaaacagggccagcagacuccauggcccaauucgguuucuucgguggugaugugaaaggagagaauuacacuuuuuuuuuuuuuaaguggcguggaggccuuugcuuccacauuuguuuuuaacccagaauuucugaaauagagaauuuaagaacacaucaaguaauaaauauacagagaauauacuuuuuuauaaagcacaugcaucugcuauuguguuggguugguuuccucucuuuuccacggacaguguuguguuucuggcauagggaaacuccaaacaacuugcacaccucuacuccggagcugagauuucuuuuacauagaugaccucgcuucaaauacguuaccuuacugaugauaggaucuuuucuuguagcacuauaccuugugggaauuuuuuuuuaaauguacaccugauuugagaagcugaagaaaacaaaauuuugaagcacucacuuugaggaguacagguaauguuuuaaaaaauugcacaaaagaaaaaugaaugucgaaaugauucauucaguguuugaaagauauggcucuguugaaacaaugaguuucauacuuuguuuguaaaaaaaaaaaagcagagaaggguugaaaguuacauguuuuuuuguauauagaaauuugucaugucuaaaugaucagauuuguaugguuauggccuggaagaauuacuacguaaaaggcucuuaaacuauaccuaugcuuauuguuauuuuuguuacauauagcccucgucugagggaggggaacucgguauucugcgauuugagaauacuguucauuccuaugcugaaaguacuucucugagcucccuucuuagucuaaacucuuaagccauugcaacuucuuuuucuucagagaugauguuugacauuuucagcacuuccuguuccuauaaacccaaagaauauaaucuugaacacgaaguguuuguaacaagggauccaggcuaccaaucaaacaggacucauuauggggacaaaaaaaaaaauuauuucaccuucuuuccccccacaccucauuuaaauggggggaguaaaaacaugauuucaauguaaaugccucauuuuauuuuaguuuuauuuugauuuuuauuuaauauaaagaggccagaauaaauacggagcaucuucucagaauaguauuccuguccaaaaaucaagccggacaguggaaacuggacagcuguggggauauuaagcacccccacuuacaauucuuaaauucagaaucucguccccucccuucucguugaaggcaacuguucugguagcuaacuuucuccuguguaauggcgggagggaacaccggcuucaguuuuucauguccccaugacuugcauacaaaugguucaacuguauuaaaauuaagugcauuuggccaauagguaguaucuauacaauaacaacaaucucuaagaauuuccauaacuuuucuuaucugaaaggacucaagucuuccacugcagauacauuggaggcuucacccacguuuucuuucccuuuaguuuguuugcugucuggauggccaaugagccugucuccuuuucuguggccaaucugaaggccuucguuggaaguguuguuuacaguaauccuuaccaagauaacauacuguccuccagaauaccaaguauuaggugacacuagcucaagcuguugucuucagagcaguuaccaagaagcucggugcacagguuuucucugguucuuacaggaaccaccuacucuuucaguuuucuggcccaggagugggguaaauccuuuaguuagugcauuugaacuugauaccugugcauucaguucugugaauacugcccuuuuuggcgggguuuccucaucuccccagccugaacugcucaacucuaaacccaaauuagugucagccgaaaggagguuucaagauaguccugucaguauuuguggugaccuucagauuagacagucuucauuuccagccaguggaguccuggcuccagagccaucucugagacucguacuacuggauguuuuaauaucagaucauuacccaccauaugccucccacaggccaagggaaaacagacaccagaacuuggguugagggcacuaccagacugacauggccaguacagaggagaacuagggaaggaaugauguuuugcaccuuauugaaaagaaaauuuuaagugcauacauaauaguuaagagcuuuuauugugacaggagaacuuuuuuccauaugcgugcauacucucuguaauuccaguguaaaauauuguacuugcacuagcuuuuuuaaacaaauauuaaaaaauggaagaauucauauucuauuuucuaaucguggugugucuauuuguaggauacacucgagucuguuuauugaauuuuauggucccuuucuuugauggugcuugcagguuuucuagguagaaauuauuucauuauuauaauaaaacaauguuugauucaaaauuugaacaaaauuguuuuaaauaaauugucuguauaccaguacaaguuuauuguuucaguauacucguacuaauaaaauaacagugccaauugca

SEQ ID NO: 281 - RNA, 6422 nt, Homo_Sapiens
guuuucuguugaucugccaggaccuuuguaauucaagugcuuuuuacaguaguagcaaauguuacauaagcccaaacauggagcauauuuggaguuggugggcagacccaaaucaugaugcaagccugcaguagcaagugugcaaugaagcacaaccaaauucugugaauggaagguagcaagacgccucuccaaagcagcccuucugcgcaggagcugaaagcuccacuggaaagaagacauagcucauccagcaagccgccuuuggccguuccucccacuucaguauuuuccuucuucccuucucuguccaaaagcaaaggaggcagugcaaguggaagcaaccguucuuccaguggagguguucuuagcgcauccucaucaaguuccaaguuguugaaaucacccaaagagaaacugcagcucagggggaacaccaggccaaugcaucccauucagcaaaguagaguuccccaugguagaaucaugacacccucugugaaaguggaaaagauucauccgaaaauggauggcacacuacugaaaucugcgguggggccaaccuguccugcuacugugaguuccuuagucaagccuggccuuaacugccccucaauaccaaagccaaccuugccuucaccuggacagauucugaauggcaaagggcuuccugcaccgcccacucuggaaaagaaaccugaagacaauuccaauaauaggaaauuuuuaaauaagagauuaucagaaagagaguuugauccugacauccacugugggguuauugaucucgacaccaagaagcccugcacccggucuuugacaugcaagacacauuccuuaacccagcgcagggcuguccaggguagaagaaaacgauuugauguguuauuagccgagcacaaaaacaaaaccagggaaaaggaauugauucgccauccggacucucagcaaccaccgcagccucucagggacccgcaucccgccccuccuagaacgucacaggagccgcaccaaaacccucacggagugauuccuuccgaaucaaagccuuuuguagcuaguaaaccuaaaccucacacccccagucuuccaaggccuccaggcugcccugcucagcaaggugggagugcccccauugacccuccuccaguccaugaaucuccacacccuccccugccugccacugagccagcuucucgguuauccagugaggagggcgaaggcgaugacaaagaagagucuguugaaaaacuggacugucauuauucaggucaucauccucagccagcaucuuuuugcacauuugggagccggcagauaggaagaggcuauuacguguuugacuccagguggaaucgacuucgcugcgcccucaaccucaugguggagaagcaucugaaugcacagcuauggaagaaaaucccaccagugcccaguaccaccucacccaucuccacacguauuccucaccggacaaacucugugccgacaucacaauguggagucagcuaucuggcagcagccaccgucucuacauccccaguccugcucucaucuaccugcaucuccccaaauagcaaaucgguaccagcucauggaaccacacuaaaugcacagccugcugcuucaggggcgauggauccugugugcaguaugcaauccagacaaguguccucuucauccucauccccuuccacgcccucuggccuuuccucgguuccuuccucccccauguccaggaaaccucagaaauugaaauccagcaaaucuuugaggcccaaggagucuucugguaacagcacuaacugucaaaaugccaguagcaguaccaguggcggcucaggaaagaaacgcaaaaacaguuccccacuguugguucacucuuccuccuccucuuccuccuccuccucuucuucucauuccauggagucuuuuaggaaaaacuguguggcucacucugggccucccuaccccucaacgguaacaucuucccauagcaucggccucaacugugugacgaauaaagcaaaugcggugaacguccggcaugaccagucagggaggggcccccccaccgggagcccugcugaauccaucaagaggaugagugugauggugaacagcagugauucuacucuuucucuugggccauucauucaccaguccaaugaacugccugucaacucccacggcaguuuuucccacucacacacuccucuagacaaacucauaggaaagaaaagaaagugcucacccagcucgagcagcaucaacaacagcagcagcaaacccacaaagguugccaaagugccagccgugaacaauguccacaugaaacacacaggcaccaucccaggggcacaaggacugaugaacaguucccuccuucaucagccaaaggcacgucccugacagcugaaaauagcacggggaggaauaaugcggacacuuuugaggacaaguuacaccuccacucagcacucuggacuccacgaugccuuugagucuguuuucccaaccuccugugggccucaaggguagaaaccugccgggcuguuguuuuaacgaggauuucccugaagcuaugucucuagcagugaguacucauaaaggacacuggaucaaguucagccaccgaauugcuuuuaucaguguuaaaguggucugaacugcuugcuaccaaucugugagaaguuuuuguuuuuguuuuguuuuuuaacuugcaguauaucacagagccacucuucaaguagauuggcugggcaaaagaauguuuuggcaagagcguuacuguagaccuuucucccuccuuccuuuuacuaccauuuuuuuuuaacacugucaucuguaggucacucuccagcaguuaggcaccuuaacuggagaccagaaaccuuccagagaacacagggcugcaucccgagcaacccucugaagaagggaauuaggcuuuagauuuugauagcaauguuccaggaaugaaauauagauguuagcccaagacaccaugacaaaauagcccagccuuuugagaguaauuugggaaaagaagcugucagaaguuucuaacuuacaaacugguuugaaauuuuugaugcccagacagcaaguauaaaucauuuuggaggcuuacuuuucaugauacaaaagcaauucugugugauuuuuuuuuuuaagaagaaagaaaaugcaagcuaguuuugagaaaggaaggccaaauugggucgggggagggugggagugaggaaguuaaaaucacuauagggagaaaaaacuuuuuucaagauuuccaaagagaugaaauuuucuuaauccuuuuaaguuuucauaguaaacaguauggcagauuggguugguuguccuaccuggucuauuuuuaaaagucaccuuuuaaagugacauuauuagauacacuuaaauguuuccaaggcacucucuacauuacccuuguuuuucucuuuggauacuguccugggacuaaguguagauuucugcuucaagcacuucuggcauuguguguuuuuguaugcacuccccuucaugccacuucagauguuuauuuggaugugguuggggacgagagcagacaccaaggaaagggaguuggagagaauguaaguccugaccugaaggucuuuugugaugcauguauaggauugcccugacacacacccuccuuucuugggauuauaccagccaucuuccugagaguuuuggagcccucuaggauauuuuuucuaguaccccaccccccaccccuaaagaaagaccuuaauauguuaaaacagcauugcuuggagaaggugucauugaauuccgggacgagccggagccuuuaaaugggugcuuccaccacuacaggcuccugacacgaguaacaggcacuguugcuuagaagaacacacgaaguugccgaacacaggguaaaauuuccaaggcgcugaucguugcccuggccagggccugaugagagccagucaguacauucuuuuuuuccuacaguucuuggguuucaaacuucaguuucagggaauuucaagucaacaacagguagaaugaauaaacuugguuaccagccuaauaaugugaauugcuacagaauuauucuuauuauguaagaaaacaaaaacuuuaugcagauacuuuagcuauaaauugauguaaaauacugauuuuuuuaaaggaaggagagaacaguaucuuguucaauuauuaugcaaucaaucaguaaauguuuuuaaaaugauacuacaggagagcuuaguaaggagagggcauggaugggccaguuuggcauaguugggagaaaucagucugguuuccaucccagucggggaagagagaggugagagggaaucagaacguaccuaguugauuccuuggugacaagugcaaugggguauggguagaauuuauuuucagagccaagaggacuugaugguuauaaauaaaguugccuuuagcaauggaauuuacagaucgaucauguuguuccgaaagaugugaauaggauccacaauaacaaguugauucagacuaauguagauauuuagauuagcaaguauugaacauuugauuucuuagacugagguuuuaaaugaauuucauuauuucucccgguaauacacagagcaucgggauuaggaaauuagccauuuuggauucugucugccacaaacagaccuauucuaaacagugcuauuaaauuuuagacuguuguucaaauauuuuauuuucuccuaaacuacuuuuuauggugaugaauaauuaagaccauuuaaaacacgggaguacaaguauuuuuuugaauuaaauuaacuugcaaaaaccaaauuugcagugguuggguuguuucuagacagacuuugguaucaauuuaaaaccaagauaauuuuuauauucuuuccaauagaauuucaugacaacuccugcaguuuucuuaaccuacaaaaaaaaaaaaaaagugcugcaaugaugaacaaagaauuauacaaaaccuacuuuuguaucuuuauuuuggaauuucuuguucuauuauaaauauggaaguaucccuauuucagaagacauauuuuguuaaaaaugaauuguacauauuuaaauauguauuuuugcacaggucuuuuuuucugauauccuguuuugguacaauugagaucaucuaguauuuauuuauuaauuaauaaaaguaaauaccuuuuuauaauuugaagugguucacugccaagccaauaguucuagaaccugccuccuuuacaguuuuaagggaugccucuguucugugaaaagucuuugucccuuuuagugucucgggaguggauucauacagaugaagugggcauugcuucuuccugguugccugguuucccgauagacuacauguaacuaagugacacacugcuuuucuuuuguuaguauuuuaugugugggaguaugugacugcgugugugugugccugugcguguguguguauacucagcacauguauguuacuaugugaugugguuuaaaacuaauggaaaaaacugaaagugccugaaacuaguuuuaagcuuagacagaaucucuuuaaaaagacuugaauguucaguugaacuuuuggaguuugcuuuuuccaccuaaauauuguuucuaaaauuuuaggggcggaguugaaaaccaccaaugcugguaauuuuauaagguauuuuaaaauuaagaccucuugguucauaguaauucaauuggugauggauugccugguggcaccaaggguuacagaucuuuuugucagccagcaacuuacacgauguguccguuuuguuauucacucaugaaauacaauuuaaaauauuuaaaauauuuuguauuccaaaaauauaauacaaagaaguaccucugagaacauugaaaaaaauguauaauuugaaaaauguaacuuauaagggcagcugucuuccugcaagaguucuguugccaaggaauuucuuaaugucgcucauucuguccaggggguuuggggcgauugggcuuugaaaaaauauucuuaaaaguuuguuuagcagaaaauaaucacuuuuacauuuugugcaaaacauuuuacauuuucagauaauuuaaaugagcacuacauacugucagugugaauguagggccuugaaagcauuuugcuuuuuuuuuuuuuuuuuuuuuuuugagcuugguuauaaaagcaaucuccuguguuaaaaacgugugaauaguuugauaauuuguacacauaaucaagagcaucucagcuggacuuuguguuggcugcuguauagaacaugaacaaaugucaagggauagaaaauuacuuuggauauuuaaaagagaagaaauauauagucuauuuguuuuguaacaaguuucuguaaauaaaauaauuuauacuauuuauaagaaaaaaaaaaaaaaaaaaa

SEQ ID NO: 282 - RNA, 6866 nt, Homo_Sapiens
aucugaacagaauuaagacgaacgagcuuucacaauugcagcagaugaagauccauugguaaauugaucaggauuuuuggccuacccuccaaagaaaaggagcggaaagaaugucggagcgggccgcggaugacgucaggggggagccgcgccgcgcggcggcggcggcgggcggagcagcggccgcggccgcccggcagcagcagcagcagcagcagcagcagcagccgccgccuccgcagccccagcggcagcagcacccgccaccgccgccacggcgcacacggccggaggacggcgggcccggcgccgccuccaccucggccgccgcaauggcgacggucggggagcgcaggccucugcccaguccugaagugaugcugggacagucguggaaucuguggguugaggcuuccaaacuuccugggaaggacgggacagaauuggacgaaaguuucaaggaguuugggaaaaaccgcgaagucauggggcucugucgggaagacaugccaauauuugguuucuguccagcccaugaugauuucuacuuggugguguguaacgacuguaaucagguugucaaaccgcaggcauuucaaucacauuaugaaagaagacauagcucauccagcaagccgccuuuggccguuccucccacuucaguauuuuccuucuucccuucucuguccaaaagcaaaggaggcagugcaaguggaagcaaccguucuuccaguggagguguucuuagcgcauccucaucaaguuccaaguuguugaaaucacccaaagagaaacugcagcucagggggaacaccaggccaaugcaucccauucagcaaaguagaguuccccaugguagaaucaugacacccucugugaaaguggaaaagauucauccgaaaauggauggcacacuacugaaaucugcgguggggccaaccuguccugcuacugugaguuccuuagucaagccuggccuuaacugccccucaauaccaaagccaaccuugccuucaccuggacagauucugaauggcaaagggcuuccugcaccgcccacucuggaaaagaaaccugaagacaauuccaauaauaggaaauuuuuaaauaagagauuaucagaaagagaguuugauccugacauccacugugggguuauugaucucgacaccaagaagcccugcacccggucuuugacaugcaagacacauuccuuaacccagcgcagggcuguccaggguagaagaaaacgauuugauguguuauuagccgagcacaaaaacaaaaccagggaaaaggaauugauucgccauccggacucucagcaaccaccgcagccucucagggacccgcaucccgccccuccuagaacgucacaggagccgcaccaaaacccucacggagugauuccuuccgaaucaaagccuuuuguagcuaguaaaccuaaaccucacacccccagucuuccaaggccuccaggcugcccugcucagcaaggugggagugcccccauugacccuccuccaguccaugaaucuccacacccuccccugccugccacugagccagcuucucgguuauccagugaggagggcgaaggcgaugacaaagaagagucuguugaaaaacuggacugucauuauucaggucaucauccucagccagcaucuuuuugcacauuugggagccggcagauaggaagaggcuauuacguguuugacuccagguggaaucgacuucgcugcgcccucaaccucaugguggagaagcaucugaaugcacagcuauggaagaaaaucccaccagugcccaguaccaccucacccaucuccacacguauuccucaccggacaaacucugugccgacaucacaauguggagucagcuaucuggcagcagccaccgucucuacauccccaguccugcucucaucuaccugcaucuccccaaauagcaaaucgguaccagcucauggaaccacacuaaaugcacagccugcugcuucaggggcgauggauccugugugcaguaugcaauccagacaaguguccucuucauccucauccccuuccacgcccucuggccuuuccucgguuccuuccucccccauguccaggaaaccucagaaauugaaauccagcaaaucuuugaggcccaaggagucuucugguaacagcacuaacugucaaaaugccaguagcaguaccaguggcggcucaggaaagaaacgcaaaaacaguuccccacuguugguucacucuuccuccuccucuuccuccuccuccucuucuucucauuccauggagucuuuuaggaaaaacuguguggcucacucugggccucccuaccccucaacgguaacaucuucccauagcaucggccucaacugugugacgaauaaagcaaaugcggugaacguccggcaugaccagucagggaggggcccccccaccgggagcccugcugaauccaucaagaggaugagugugauggugaacagcagugauucuacucuuucucuugggccauucauucaccaguccaaugaacugccugucaacucccacggcaguuuuucccacucacacacuccucuagacaaacucauaggaaagaaaagaaagugcucacccagcucgagcagcaucaacaacagcagcagcaaacccacaaagguugccaaagugccagccgugaacaauguccacaugaaacacacaggcaccaucccaggggcacaaggacugaugaacaguucccuccuucaucaggauaucuccucaccuugcuuacgaacaggaauuucagcaacaucaccccagagcccugacuuaaaauccaaaggcacgucccugacagcugaaaauagcacggggaggaauaaugcggacacuuuugaggacaaguuacaccuccacucagcacucuggacuccacgaugccuuugagucuguuuucccaaccuccugugggccucaaggguagaaaccugccgggcuguuguuuuaacgaggauuucccugaagcuaugucucuagcagugaguacucauaaaggacacuggaucaaguucagccaccgaauugcuuuuaucaguguuaaaguggucugaacugcuugcuaccaaucugugagaaguuuuuguuuuuguuuuguuuuuuaacuugcaguauaucacagagccacucuucaaguagauuggcugggcaaaagaauguuuuggcaagagcguuacuguagaccuuucucccuccuuccuuuuacuaccauuuuuuuuuaacacugucaucuguaggucacucuccagcaguuaggcaccuuaacuggagaccagaaaccuuccagagaacacagggcugcaucccgagcaacccucugaagaagggaauuaggcuuuagauuuugauagcaauguuccaggaaugaaauauagauguuagcccaagacaccaugacaaaauagcccagccuuuugagaguaauuugggaaaagaagcugucagaaguuucuaacuuacaaacugguuugaaauuuuugaugcccagacagcaaguauaaaucauuuuggaggcuuacuuuucaugauacaaaagcaauucugugugauuuuuuuuuuuaagaagaaagaaaaugcaagcuaguuuugagaaaggaaggccaaauugggucgggggagggugggagugaggaaguuaaaaucacuauagggagaaaaaacuuuuuucaagauuuccaaagagaugaaauuuucuuaauccuuuuaaguuuucauaguaaacaguauggcagauuggguugguuguccuaccuggucuauuuuuaaaagucaccuuuuaaagugacauuauuagauacacuuaaauguuuccaaggcacucucuacauuacccuuguuuuucucuuuggauacuguccugggacuaaguguagauuucugcuucaagcacuucuggcauuguguguuuuuguaugcacuccccuucaugccacuucagauguuuauuuggaugugguuggggacgagagcagacaccaaggaaagggaguuggagagaauguaaguccugaccugaaggucuuuugugaugcauguauaggauugcccugacacacacccuccuuucuugggauuauaccagccaucuuccugagaguuuuggagcccucuaggauauuuuuucuaguaccccaccccccaccccuaaagaaagaccuuaauauguuaaaacagcauugcuuggagaaggugucauugaauuccgggacgagccggagccuuuaaaugggugcuuccaccacuacaggcuccugacacgaguaacaggcacuguugcuuagaagaacacacgaaguugccgaacacaggguaaaauuuccaaggcgcugaucguugcccuggccagggccugaugagagccagucaguacauucuuuuuuuccuacaguucuuggguuucaaacuucaguuucagggaauuucaagucaacaacagguagaaugaauaaacuugguuaccagccuaauaaugugaauugcuacagaauuauucuuauuauguaagaaaacaaaaacuuuaugcagauacuuuagcuauaaauugauguaaaauacugauuuuuuuaaaggaaggagagaacaguaucuuguucaauuauuaugcaaucaaucaguaaauguuuuuaaaaugauacuacaggagagcuuaguaaggagagggcauggaugggccaguuuggcauaguugggagaaaucagucugguuuccaucccagucggggaagagagaggugagagggaaucagaacguaccuaguugauuccuuggugacaagugcaaugggguauggguagaauuuauuuucagagccaagaggacuugaugguuauaaauaaaguugccuuuagcaauggaauuuacagaucgaucauguuguuccgaaagaugugaauaggauccacaauaacaaguugauucagacuaauguagauauuuagauuagcaaguauugaacauuugauuucuuagacugagguuuuaaaugaauuucauuauuucucccgguaauacacagagcaucgggauuaggaaauuagccauuuuggauucugucugccacaaacagaccuauucuaaacagugcuauuaaauuuuagacuguuguucaaauauuuuauuuucuccuaaacuacuuuuuauggugaugaauaauuaagaccauuuaaaacacgggaguacaaguauuuuuuugaauuaaauuaacuugcaaaaaccaaauuugcagugguuggguuguuucuagacagacuuugguaucaauuuaaaaccaagauaauuuuuauauucuuuccaauagaauuucaugacaacuccugcaguuuucuuaaccuacaaaaaaaaaaaaaaagugcugcaaugaugaacaaagaauuauacaaaaccuacuuuuguaucuuuauuuuggaauuucuuguucuauuauaaauauggaaguaucccuauuucagaagacauauuuuguuaaaaaugaauuguacauauuuaaauauguauuuuugcacaggucuuuuuuucugauauccuguuuugguacaauugagaucaucuaguauuuauuuauuaauuaauaaaaguaaauaccuuuuuauaauuugaagugguucacugccaagccaauaguucuagaaccugccuccuuuacaguuuuaagggaugccucuguucugugaaaagucuuugucccuuuuagugucucgggaguggauucauacagaugaagugggcauugcuucuuccugguugccugguuucccgauagacuacauguaacuaagugacacacugcuuuucuuuuguuaguauuuuaugugugggaguaugugacugcgugugugugugccugugcguguguguguauacucagcacauguauguuacuaugugaugugguuuaaaacuaauggaaaaaacugaaagugccugaaacuaguuuuaagcuuagacagaaucucuuuaaaaagacuugaauguucaguugaacuuuuggaguuugcuuuuuccaccuaaauauuguuucuaaaauuuuaggggcggaguugaaaaccaccaaugcugguaauuuuauaagguauuuuaaaauuaagaccucuugguucauaguaauucaauuggugauggauugccugguggcaccaaggguuacagaucuuuuugucagccagcaacuuacacgauguguccguuuuguuauucacucaugaaauacaauuuaaaauauuuaaaauauuuuguauuccaaaaauauaauacaaagaaguaccucugagaacauugaaaaaaauguauaauuugaaaaauguaacuuauaagggcagcugucuuccugcaagaguucuguugccaaggaauuucuuaaugucgcucauucuguccaggggguuuggggcgauugggcuuugaaaaaauauucuuaaaaguuuguuuagcagaaaauaaucacuuuuacauuuugugcaaaacauuuuacauuuucagauaauuuaaaugagcacuacauacugucagugugaauguagggccuugaaagcauuuugcuuuuuuuuuuuuuuuuuuuuuuuugagcuugguuauaaaagcaaucuccuguguuaaaaacgugugaauaguuugauaauuuguacacauaaucaagagcaucucagcuggacuuuguguuggcugcuguauagaacaugaacaaaugucaagggauagaaaauuacuuuggauauuuaaaagagaagaaauauauagucuauuuguuuuguaacaaguuucuguaaauaaaauaauuuauacuauuuauaagaaaaaaaaaaaaaaaaaaa

SEQ ID NO: 283 - RNA, 7242 nt, Homo_Sapiens
gaaaaagggugaaagagaaacuuggcgaccucccggaggaguucgcgaagcgaccaggagcguguugccaucguccucacccggcacccaauuccaccacagagucgggauuucgucggugaucgugauggggugcuuuuauuuuucucuuugauuuucaaaaaaugucuaugugacugucccuaucuuaaggggaaguugaaagugggggcgggggugcucaaugagaaacguugccuuguguguaguuguuuggagcacacugcaaauuauauuggcaucucuuuccaaaagucacuuugauucaacuucgauagcuuucucguaaauggcacguuuagguggugagagguggaugaggaaacaggcaccagugcagcugauuugaccuccagugggauagauacgauuagcaccaggaucgugucucauuuugaacccagaucugaacagaauuaagacgaacgagcuuucacaauugcagcagaugaagauccauugguaaauugaucaggauuuuuggccuacccuccaaagaaaaggagcggaaagaaugucggagcgggccgcggaugacgucaggggggagccgcgccgcgcggcggcggcggcgggcggagcagcggccgcggccgcccggcagcagcagcagcagcagcagcagcagcagccgccgccuccgcagccccagcggcagcagcacccgccaccgccgccacggcgcacacggccggaggacggcgggcccggcgccgccuccaccucggccgccgcaauggcgacggucggggagcgcaggccucugcccaguccugaagugaugcugggacagucguggaaucuguggguugaggcuuccaaacuuccugggaaggacgggacagaauuggacgaaaguuucaaggaguuugggaaaaaccgcgaagucauggggcucugucgggaagacaugccaauauuugguuucuguccagcccaugaugauuucuacuuggugguguguaacgacuguaaucagguugucaaaccgcaggcauuucaaucacauuaugaaagaagacauagcucauccagcaagccgccuuuggccguuccucccacuucaguauuuuccuucuucccuucucuguccaaaagcaaaggaggcagugcaaguggaagcaaccguucuuccaguggagguguucuuagcgcauccucaucaaguuccaaguuguugaaaucacccaaagagaaacugcagcucagggggaacaccaggccaaugcaucccauucagcaaaguagaguuccccaugguagaaucaugacacccucugugaaaguggaaaagauucauccgaaaauggauggcacacuacugaaaucugcgguggggccaaccuguccugcuacugugaguuccuuagucaagccuggccuuaacugccccucaauaccaaagccaaccuugccuucaccuggacagauucugaauggcaaagggcuuccugcaccgcccacucuggaaaagaaaccugaagacaauuccaauaauaggaaauuuuuaaauaagagauuaucagaaagagaguuugauccugacauccacugugggguuauugaucucgacaccaagaagcccugcacccggucuuugacaugcaagacacauuccuuaacccagcgcagggcuguccaggguagaagaaaacgauuugauguguuauuagccgagcacaaaaacaaaaccagggaaaaggaauugauucgccauccggacucucagcaaccaccgcagccucucagggacccgcaucccgccccuccuagaacgucacaggagccgcaccaaaacccucacggagugauuccuuccgaaucaaagccuuuuguagcuaguaaaccuaaaccucacacccccagucuuccaaggccuccaggcugcccugcucagcaaggugggagugcccccauugacccuccuccaguccaugaaucuccacacccuccccugccugccacugagccagcuucucgguuauccagugaggagggcgaaggcgaugacaaagaagagucuguugaaaaacuggacugucauuauucaggucaucauccucagccagcaucuuuuugcacauuugggagccggcagauaggaagaggcuauuacguguuugacuccagguggaaucgacuucgcugcgcccucaaccucaugguggagaagcaucugaaugcacagcuauggaagaaaaucccaccagugcccaguaccaccucacccaucuccacacguauuccucaccggacaaacucugugccgacaucacaauguggagucagcuaucuggcagcagccaccgucucuacauccccaguccugcucucaucuaccugcaucuccccaaauagcaaaucgguaccagcucauggaaccacacuaaaugcacagccugcugcuucaggggcgauggauccugugugcaguaugcaauccagacaaguguccucuucauccucauccccuuccacgcccucuggccuuuccucgguuccuuccucccccauguccaggaaaccucagaaauugaaauccagcaaaucuuugaggcccaaggagucuucugguaacagcacuaacugucaaaaugccaguagcaguaccaguggcggcucaggaaagaaacgcaaaaacaguuccccacuguugguucacucuuccuccuccucuuccuccuccuccucuucuucucauuccauggagucuuuuaggaaaaacuguguggcucacucugggccucccuaccccucaacgguaacaucuucccauagcaucggccucaacugugugacgaauaaagcaaaugcggugaacguccggcaugaccagucagggaggggcccccccaccgggagcccugcugaauccaucaagaggaugagugugauggugaacagcagugauucuacucuuucucuugggccauucauucaccaguccaaugaacugccugucaacucccacggcaguuuuucccacucacacacuccucuagacaaacucauaggaaagaaaagaaagugcucacccagcucgagcagcaucaacaacagcagcagcaaacccacaaagguugccaaagugccagccgugaacaauguccacaugaaacacacaggcaccaucccaggggcacaaggacugaugaacaguucccuccuucaucagccaaaggcacgucccugacagcugaaaauagcacggggaggaauaaugcggacacuuuugaggacaaguuacaccuccacucagcacucuggacuccacgaugccuuugagucuguuuucccaaccuccugugggccucaaggguagaaaccugccgggcuguuguuuuaacgaggauuucccugaagcuaugucucuagcagugaguacucauaaaggacacuggaucaaguucagccaccgaauugcuuuuaucaguguuaaaguggucugaacugcuugcuaccaaucugugagaaguuuuuguuuuuguuuuguuuuuuaacuugcaguauaucacagagccacucuucaaguagauuggcugggcaaaagaauguuuuggcaagagcguuacuguagaccuuucucccuccuuccuuuuacuaccauuuuuuuuuaacacugucaucuguaggucacucuccagcaguuaggcaccuuaacuggagaccagaaaccuuccagagaacacagggcugcaucccgagcaacccucugaagaagggaauuaggcuuuagauuuugauagcaauguuccaggaaugaaauauagauguuagcccaagacaccaugacaaaauagcccagccuuuugagaguaauuugggaaaagaagcugucagaaguuucuaacuuacaaacugguuugaaauuuuugaugcccagacagcaaguauaaaucauuuuggaggcuuacuuuucaugauacaaaagcaauucugugugauuuuuuuuuuuaagaagaaagaaaaugcaagcuaguuuugagaaaggaaggccaaauugggucgggggagggugggagugaggaaguuaaaaucacuauagggagaaaaaacuuuuuucaagauuuccaaagagaugaaauuuucuuaauccuuuuaaguuuucauaguaaacaguauggcagauuggguugguuguccuaccuggucuauuuuuaaaagucaccuuuuaaagugacauuauuagauacacuuaaauguuuccaaggcacucucuacauuacccuuguuuuucucuuuggauacuguccugggacuaaguguagauuucugcuucaagcacuucuggcauuguguguuuuuguaugcacuccccuucaugccacuucagauguuuauuuggaugugguuggggacgagagcagacaccaaggaaagggaguuggagagaauguaaguccugaccugaaggucuuuugugaugcauguauaggauugcccugacacacacccuccuuucuugggauuauaccagccaucuuccugagaguuuuggagcccucuaggauauuuuuucuaguaccccaccccccaccccuaaagaaagaccuuaauauguuaaaacagcauugcuuggagaaggugucauugaauuccgggacgagccggagccuuuaaaugggugcuuccaccacuacaggcuccugacacgaguaacaggcacuguugcuuagaagaacacacgaaguugccgaacacaggguaaaauuuccaaggcgcugaucguugcccuggccagggccugaugagagccagucaguacauucuuuuuuuccuacaguucuuggguuucaaacuucaguuucagggaauuucaagucaacaacagguagaaugaauaaacuugguuaccagccuaauaaugugaauugcuacagaauuauucuuauuauguaagaaaacaaaaacuuuaugcagauacuuuagcuauaaauugauguaaaauacugauuuuuuuaaaggaaggagagaacaguaucuuguucaauuauuaugcaaucaaucaguaaauguuuuuaaaaugauacuacaggagagcuuaguaaggagagggcauggaugggccaguuuggcauaguugggagaaaucagucugguuuccaucccagucggggaagagagaggugagagggaaucagaacguaccuaguugauuccuuggugacaagugcaaugggguauggguagaauuuauuuucagagccaagaggacuugaugguuauaaauaaaguugccuuuagcaauggaauuuacagaucgaucauguuguuccgaaagaugugaauaggauccacaauaacaaguugauucagacuaauguagauauuuagauuagcaaguauugaacauuugauuucuuagacugagguuuuaaaugaauuucauuauuucucccgguaauacacagagcaucgggauuaggaaauuagccauuuuggauucugucugccacaaacagaccuauucuaaacagugcuauuaaauuuuagacuguuguucaaauauuuuauuuucuccuaaacuacuuuuuauggugaugaauaauuaagaccauuuaaaacacgggaguacaaguauuuuuuugaauuaaauuaacuugcaaaaaccaaauuugcagugguuggguuguuucuagacagacuuugguaucaauuuaaaaccaagauaauuuuuauauucuuuccaauagaauuucaugacaacuccugcaguuuucuuaaccuacaaaaaaaaaaaaaaagugcugcaaugaugaacaaagaauuauacaaaaccuacuuuuguaucuuuauuuuggaauuucuuguucuauuauaaauauggaaguaucccuauuucagaagacauauuuuguuaaaaaugaauuguacauauuuaaauauguauuuuugcacaggucuuuuuuucugauauccuguuuugguacaauugagaucaucuaguauuuauuuauuaauuaauaaaaguaaauaccuuuuuauaauuugaagugguucacugccaagccaauaguucuagaaccugccuccuuuacaguuuuaagggaugccucuguucugugaaaagucuuugucccuuuuagugucucgggaguggauucauacagaugaagugggcauugcuucuuccugguugccugguuucccgauagacuacauguaacuaagugacacacugcuuuucuuuuguuaguauuuuaugugugggaguaugugacugcgugugugugugccugugcguguguguguauacucagcacauguauguuacuaugugaugugguuuaaaacuaauggaaaaaacugaaagugccugaaacuaguuuuaagcuuagacagaaucucuuuaaaaagacuugaauguucaguugaacuuuuggaguuugcuuuuuccaccuaaauauuguuucuaaaauuuuaggggcggaguugaaaaccaccaaugcugguaauuuuauaagguauuuuaaaauuaagaccucuugguucauaguaauucaauuggugauggauugccugguggcaccaaggguuacagaucuuuuugucagccagcaacuuacacgauguguccguuuuguuauucacucaugaaauacaauuuaaaauauuuaaaauauuuuguauuccaaaaauauaauacaaagaaguaccucugagaacauugaaaaaaauguauaauuugaaaaauguaacuuauaagggcagcugucuuccugcaagaguucuguugccaaggaauuucuuaaugucgcucauucuguccaggggguuuggggcgauugggcuuugaaaaaauauucuuaaaaguuuguuuagcagaaaauaaucacuuuuacauuuugugcaaaacauuuuacauuuucagauaauuuaaaugagcacuacauacugucagugugaauguagggccuugaaagcauuuugcuuuuuuuuuuuuuuuuuuuuuuuugagcuugguuauaaaagcaaucuccuguguuaaaaacgugugaauaguuugauaauuuguacacauaaucaagagcaucucagcuggacuuuguguuggcugcuguauagaacaugaacaaaugucaagggauagaaaauuacuuuggauauuuaaaagagaagaaauauauagucuauuuguuuuguaacaaguuucuguaaauaaaauaauuuauacuauuuauaagaaaaaaaaaaaaaaaaaaa

SEQ ID NO: 284 - RNA, 2755 nt, Homo_Sapiens
auuaaagaugauuuuuacagucaaugagccacgucagggagcgauggcacccgcaggcgguaucaacugaugcaaguguucaagcgaaucucaacucguuuuuuccggugacucauucccggcccugcuuggcagcgcugcacccuuuaacuuaaaccucggccggccgcccgccgggggcacagagugugcgccgggccgcgcggcaauugguccccgcgccgaccuccgcccgcgagcgccgccgcuucccuuccccgccccgcgucccucccccucggccccgcgcgucgccuguccuccgagccagucgcugacagccgcggcgccgcgagcuucuccucuccucacgaccgaggcagagcagucauuauggcgaaccuuggcugcuggaugcugguucucuuuguggccacauggagugaccugggccucugcaagaagcgcccgaagccuggaggauggaacacugggggcagccgauacccggggcagggcagcccuggaggcaaccgcuacccaccucagggcggugguggcugggggcagccucauggugguggcugggggcagccucauggugguggcugggggcagccccauggugguggcuggggacagccucauggugguggcuggggucaaggagguggcacccacagucaguggaacaagccgaguaagccaaaaaccaacaugaagcacauggcuggugcugcagcagcuggggcagugguggggggccuuggcggcuacaugcugggaagugccaugagcaggcccaucauacauuucggcagugacuaugaggaccguuacuaucgugaaaacaugcaccguuaccccaaccaaguguacuacaggcccauggaugaguacagcaaccagaacaacuuugugcacgacugcgucaauaucacaaucaagcagcacacggucaccacaaccaccaagggggagaacuucaccgagaccgacguuaagaugauggagcgcgugguugagcagauguguaucacccaguacgagagggaaucucaggccuauuaccagagaggaucgagcaugguccucuucuccucuccaccugugauccuccugaucucuuuccucaucuuccugauagugggaugaggaaggucuuccuguuuucaccaucuuucuaaucuuuuuccagcuugagggaggcgguauccaccugcagcccuuuuagugguggugucucacucuuucuucucucuuugucccggauaggcuaaucaauacccuuggcacugaugggcacuggaaaacauagaguagaccugagaugcuggucaagcccccuuugauugaguucaucaugagccguugcuaaugccaggccaguaaaaguauaacagcaaauaaccauugguuaaucuggacuuauuuuuggacuuagugcaacagguugaggcuaaaacaaaucucagaacagucugaaauaccuuugccuggauaccucuggcuccuucagcagcuagagcucaguauacuaaugcccuaucuuaguagagauuucauagcuauuuagagauauuuuccauuuuaagaaaacccgacaacauuucugccagguuuguuaggaggccacaugauacuuauucaaaaaaauccuagagauucuuagcucuugggaugcaggcucagcccgcuggagcaugagcucuguguguaccgagaacuggggugauguuuuacuuuucacaguaugggcuacacagcagcuguucaacaagaguaaauauugucacaacacugaaccucuggcuagaggacauauucacagugaacauaacuguaacauauaugaaaggcuucugggacuugaaaucaaauguuugggaauggugcccuuggaggcaaccucccauuuuagauguuuaaaggacccuauauguggcauuccuuucuuuaaacuauagguaauuaaggcagcugaaaaguaaauugccuucuagacacugaaggcaaaucuccuuuguccauuuaccuggaaaccagaaugauuuugacauacaggagagcugcaguugugaaagcaccaucaucauagaggaugauguaauuaaaaaauggucagugugcaaagaaaagaacugcuugcauuucuuuauuucugucucauaauugucaaaaaccagaauuaggucaaguucauaguuucuguaauuggcuuuugaaucaaagaauagggagacaaucuaaaaaauaucuuagguuggagaugacagaaauaugauugauuugaaguggaaaaagaaauucuguuaauguuaauuaaaguaaaauuauucccugaauuguuugauauugucaccuagcagauauguauuacuuuucugcaauguuauuauuggcuugcacuuugugaguauucuauguaaaaauauauauguauauaaaauauauauugcauaggacagacuuaggaguuuuguuuagagcaguuaacaucugaagugucuaaugcauuaacuuuuguaagguacugaauacuuaauaugugggaaacccuuuugcgugguccuuaggcuuacaaugugcacugaaucguuucauguaagaauccaaaguggacaccauuaacaggucuuugaaauaugcauguacuuuauauuuucuauauuuguaacuuugcauguucuuguuuuguuauauaaaaaaauuguaaauguuuaauaucugacugaaauuaaacgagcgaagaugagcaccaaaaaaaaaaaaaaaa

SEQ ID NO: 285 - RNA, 2751 nt, Homo_Sapiens
auuaaagaugauuuuuacagucaaugagccacgucagggagcgauggcacccgcaggcgguaucaacugaugcaaguguucaagcgaaucucaacucguuuuuuccggugacucauucccggcccugcuuggcagcgcugcacccuuuaacuuaaaccucggccggccgcccgccgggggcacagagugugcgccgggccgcgcggcaauugguccccgcgccgaccuccgcccgcgagcgccgccgcuucccuuccccgccccgcgucccucccccucggccccgcgcgucgccuguccuccgagccagucgcugacagccgcggcgccgcgagcuucuccucuccucacgaccgagagcagucauuauggcgaaccuuggcugcuggaugcugguucucuuuguggccacauggagugaccugggccucugcaagaagcgcccgaagccuggaggauggaacacugggggcagccgauacccggggcagggcagcccuggaggcaaccgcuacccaccucagggcggugguggcugggggcagccucauggugguggcugggggcagccucauggugguggcugggggcagccccauggugguggcuggggacagccucauggugguggcuggggucaaggagguggcacccacagucaguggaacaagccgaguaagccaaaaaccaacaugaagcacauggcuggugcugcagcagcuggggcagugguggggggccuuggcggcuacaugcugggaagugccaugagcaggcccaucauacauuucggcagugacuaugaggaccguuacuaucgugaaaacaugcaccguuaccccaaccaaguguacuacaggcccauggaugaguacagcaaccagaacaacuuugugcacgacugcgucaauaucacaaucaagcagcacacggucaccacaaccaccaagggggagaacuucaccgagaccgacguuaagaugauggagcgcgugguugagcagauguguaucacccaguacgagagggaaucucaggccuauuaccagagaggaucgagcaugguccucuucuccucuccaccugugauccuccugaucucuuuccucaucuuccugauagugggaugaggaaggucuuccuguuuucaccaucuuucuaaucuuuuuccagcuugagggaggcgguauccaccugcagcccuuuuagugguggugucucacucuuucuucucucuuugucccggauaggcuaaucaauacccuuggcacugaugggcacuggaaaacauagaguagaccugagaugcuggucaagcccccuuugauugaguucaucaugagccguugcuaaugccaggccaguaaaaguauaacagcaaauaaccauugguuaaucuggacuuauuuuuggacuuagugcaacagguugaggcuaaaacaaaucucagaacagucugaaauaccuuugccuggauaccucuggcuccuucagcagcuagagcucaguauacuaaugcccuaucuuaguagagauuucauagcuauuuagagauauuuuccauuuuaagaaaacccgacaacauuucugccagguuuguuaggaggccacaugauacuuauucaaaaaaauccuagagauucuuagcucuugggaugcaggcucagcccgcuggagcaugagcucuguguguaccgagaacuggggugauguuuuacuuuucacaguaugggcuacacagcagcuguucaacaagaguaaauauugucacaacacugaaccucuggcuagaggacauauucacagugaacauaacuguaacauauaugaaaggcuucugggacuugaaaucaaauguuugggaauggugcccuuggaggcaaccucccauuuuagauguuuaaaggacccuauauguggcauuccuuucuuuaaacuauagguaauuaaggcagcugaaaaguaaauugccuucuagacacugaaggcaaaucuccuuuguccauuuaccuggaaaccagaaugauuuugacauacaggagagcugcaguugugaaagcaccaucaucauagaggaugauguaauuaaaaaauggucagugugcaaagaaaagaacugcuugcauuucuuuauuucugucucauaauugucaaaaaccagaauuaggucaaguucauaguuucuguaauuggcuuuugaaucaaagaauagggagacaaucuaaaaaauaucuuagguuggagaugacagaaauaugauugauuugaaguggaaaaagaaauucuguuaauguuaauuaaaguaaaauuauucccugaauuguuugauauugucaccuagcagauauguauuacuuuucugcaauguuauuauuggcuugcacuuugugaguauucuauguaaaaauauauauguauauaaaauauauauugcauaggacagacuuaggaguuuuguuuagagcaguuaacaucugaagugucuaaugcauuaacuuuuguaagguacugaauacuuaauaugugggaaacccuuuugcgugguccuuaggcuuacaaugugcacugaaucguuucauguaagaauccaaaguggacaccauuaacaggucuuugaaauaugcauguacuuuauauuuucuauauuuguaacuuugcauguucuuguuuuguuauauaaaaaaauuguaaauguuuaauaucugacugaaauuaaacgagcgaagaugagcaccaaaaaaaaaaaaaaaa

SEQ ID NO: 286 - RNA, 2750 nt, Homo_Sapiens
auuaaagaugauuuuuacagucaaugagccacgucagggagcgauggcacccgcaggcgguaucaacugaugcaaguguucaagcgaaucucaacucguuuuuuccggugacucauucccggcccugcuuggcagcgcugcacccuuuaacuuaaaccucggccggccgcccgccgggggcacagagugugcgccgggccgcgcggcaauugguccccgcgccgaccuccgcccgcgagcgccgccgcuucccuuccccgccccgcgucccucccccucggccccgcgcgucgccuguccuccgagccagucgcugacagccgcggcgccgcgagcuucuccucuccucacgaccgaggcagucauuauggcgaaccuuggcugcuggaugcugguucucuuuguggccacauggagugaccugggccucugcaagaagcgcccgaagccuggaggauggaacacugggggcagccgauacccggggcagggcagcccuggaggcaaccgcuacccaccucagggcggugguggcugggggcagccucauggugguggcugggggcagccucauggugguggcugggggcagccccauggugguggcuggggacagccucauggugguggcuggggucaaggagguggcacccacagucaguggaacaagccgaguaagccaaaaaccaacaugaagcacauggcuggugcugcagcagcuggggcagugguggggggccuuggcggcuacaugcugggaagugccaugagcaggcccaucauacauuucggcagugacuaugaggaccguuacuaucgugaaaacaugcaccguuaccccaaccaaguguacuacaggcccauggaugaguacagcaaccagaacaacuuugugcacgacugcgucaauaucacaaucaagcagcacacggucaccacaaccaccaagggggagaacuucaccgagaccgacguuaagaugauggagcgcgugguugagcagauguguaucacccaguacgagagggaaucucaggccuauuaccagagaggaucgagcaugguccucuucuccucuccaccugugauccuccugaucucuuuccucaucuuccugauagugggaugaggaaggucuuccuguuuucaccaucuuucuaaucuuuuuccagcuugagggaggcgguauccaccugcagcccuuuuagugguggugucucacucuuucuucucucuuugucccggauaggcuaaucaauacccuuggcacugaugggcacuggaaaacauagaguagaccugagaugcuggucaagcccccuuugauugaguucaucaugagccguugcuaaugccaggccaguaaaaguauaacagcaaauaaccauugguuaaucuggacuuauuuuuggacuuagugcaacagguugaggcuaaaacaaaucucagaacagucugaaauaccuuugccuggauaccucuggcuccuucagcagcuagagcucaguauacuaaugcccuaucuuaguagagauuucauagcuauuuagagauauuuuccauuuuaagaaaacccgacaacauuucugccagguuuguuaggaggccacaugauacuuauucaaaaaaauccuagagauucuuagcucuugggaugcaggcucagcccgcuggagcaugagcucuguguguaccgagaacuggggugauguuuuacuuuucacaguaugggcuacacagcagcuguucaacaagaguaaauauugucacaacacugaaccucuggcuagaggacauauucacagugaacauaacuguaacauauaugaaaggcuucugggacuugaaaucaaauguuugggaauggugcccuuggaggcaaccucccauuuuagauguuuaaaggacccuauauguggcauuccuuucuuuaaacuauagguaauuaaggcagcugaaaaguaaauugccuucuagacacugaaggcaaaucuccuuuguccauuuaccuggaaaccagaaugauuuugacauacaggagagcugcaguugugaaagcaccaucaucauagaggaugauguaauuaaaaaauggucagugugcaaagaaaagaacugcuugcauuucuuuauuucugucucauaauugucaaaaaccagaauuaggucaaguucauaguuucuguaauuggcuuuugaaucaaagaauagggagacaaucuaaaaaauaucuuagguuggagaugacagaaauaugauugauuugaaguggaaaaagaaauucuguuaauguuaauuaaaguaaaauuauucccugaauuguuugauauugucaccuagcagauauguauuacuuuucugcaauguuauuauuggcuugcacuuugugaguauucuauguaaaaauauauauguauauaaaauauauauugcauaggacagacuuaggaguuuuguuuagagcaguuaacaucugaagugucuaaugcauuaacuuuuguaagguacugaauacuuaauaugugggaaacccuuuugcgugguccuuaggcuuacaaugugcacugaaucguuucauguaagaauccaaaguggacaccauuaacaggucuuugaaauaugcauguacuuuauauuuucuauauuuguaacuuugcauguucuuguuuuguuauauaaaaaaauuguaaauguuuaauaucugacugaaauuaaacgagcgaagaugagcaccaaaaaaaaaaaaaaaa

SEQ ID NO: 287 - RNA, 2746 nt, Homo_Sapiens
auuaaagaugauuuuuacagucaaugagccacgucagggagcgauggcacccgcaggcgguaucaacugaugcaaguguucaagcgaaucucaacucguuuuuuccggugacucauucccggcccugcuuggcagcgcugcacccuuuaacuuaaaccucggccggccgcccgccgggggcacagagugugcgccgggccgcgcggcaauugguccccgcgccgaccuccgcccgcgagcgccgccgcuucccuuccccgccccgcgucccucccccucggccccgcgcgucgccuguccuccgagccagucgcugacagccgcggcgccgcgagcuucuccucuccucacgaccgagucauuauggcgaaccuuggcugcuggaugcugguucucuuuguggccacauggagugaccugggccucugcaagaagcgcccgaagccuggaggauggaacacugggggcagccgauacccggggcagggcagcccuggaggcaaccgcuacccaccucagggcggugguggcugggggcagccucauggugguggcugggggcagccucauggugguggcugggggcagccccauggugguggcuggggacagccucauggugguggcuggggucaaggagguggcacccacagucaguggaacaagccgaguaagccaaaaaccaacaugaagcacauggcuggugcugcagcagcuggggcagugguggggggccuuggcggcuacaugcugggaagugccaugagcaggcccaucauacauuucggcagugacuaugaggaccguuacuaucgugaaaacaugcaccguuaccccaaccaaguguacuacaggcccauggaugaguacagcaaccagaacaacuuugugcacgacugcgucaauaucacaaucaagcagcacacggucaccacaaccaccaagggggagaacuucaccgagaccgacguuaagaugauggagcgcgugguugagcagauguguaucacccaguacgagagggaaucucaggccuauuaccagagaggaucgagcaugguccucuucuccucuccaccugugauccuccugaucucuuuccucaucuuccugauagugggaugaggaaggucuuccuguuuucaccaucuuucuaaucuuuuuccagcuugagggaggcgguauccaccugcagcccuuuuagugguggugucucacucuuucuucucucuuugucccggauaggcuaaucaauacccuuggcacugaugggcacuggaaaacauagaguagaccugagaugcuggucaagcccccuuugauugaguucaucaugagccguugcuaaugccaggccaguaaaaguauaacagcaaauaaccauugguuaaucuggacuuauuuuuggacuuagugcaacagguugaggcuaaaacaaaucucagaacagucugaaauaccuuugccuggauaccucuggcuccuucagcagcuagagcucaguauacuaaugcccuaucuuaguagagauuucauagcuauuuagagauauuuuccauuuuaagaaaacccgacaacauuucugccagguuuguuaggaggccacaugauacuuauucaaaaaaauccuagagauucuuagcucuugggaugcaggcucagcccgcuggagcaugagcucuguguguaccgagaacuggggugauguuuuacuuuucacaguaugggcuacacagcagcuguucaacaagaguaaauauugucacaacacugaaccucuggcuagaggacauauucacagugaacauaacuguaacauauaugaaaggcuucugggacuugaaaucaaauguuugggaauggugcccuuggaggcaaccucccauuuuagauguuuaaaggacccuauauguggcauuccuuucuuuaaacuauagguaauuaaggcagcugaaaaguaaauugccuucuagacacugaaggcaaaucuccuuuguccauuuaccuggaaaccagaaugauuuugacauacaggagagcugcaguugugaaagcaccaucaucauagaggaugauguaauuaaaaaauggucagugugcaaagaaaagaacugcuugcauuucuuuauuucugucucauaauugucaaaaaccagaauuaggucaaguucauaguuucuguaauuggcuuuugaaucaaagaauagggagacaaucuaaaaaauaucuuagguuggagaugacagaaauaugauugauuugaaguggaaaaagaaauucuguuaauguuaauuaaaguaaaauuauucccugaauuguuugauauugucaccuagcagauauguauuacuuuucugcaauguuauuauuggcuugcacuuugugaguauucuauguaaaaauauauauguauauaaaauauauauugcauaggacagacuuaggaguuuuguuuagagcaguuaacaucugaagugucuaaugcauuaacuuuuguaagguacugaauacuuaauaugugggaaacccuuuugcgugguccuuaggcuuacaaugugcacugaaucguuucauguaagaauccaaaguggacaccauuaacaggucuuugaaauaugcauguacuuuauauuuucuauauuuguaacuuugcauguucuuguuuuguuauauaaaaaaauuguaaauguuuaauaucugacugaaauuaaacgagcgaagaugagcaccaaaaaaaaaaaaaaaa

SEQ ID NO: 288 - RNA, 2619 nt, Homo_Sapiens
agguaaacgcccggggugggaggaacgcgggcgggggcaggggagccgcgggggccgagugaggaccccgggccucgggucccaggcgcaagggugcccggccgggcggggucgggaccccagugaggaggggccgggggcugccccgcgggcgcgugacgcgucucgggccugcccggcugcgcuggucuccgcucgggugaggcggcuuggcuucgcuuuucagagcagucauuauggcgaaccuuggcugcuggaugcugguucucuuuguggccacauggagugaccugggccucugcaagaagcgcccgaagccuggaggauggaacacugggggcagccgauacccggggcagggcagcccuggaggcaaccgcuacccaccucagggcggugguggcugggggcagccucauggugguggcugggggcagccucauggugguggcugggggcagccccauggugguggcuggggacagccucauggugguggcuggggucaaggagguggcacccacagucaguggaacaagccgaguaagccaaaaaccaacaugaagcacauggcuggugcugcagcagcuggggcagugguggggggccuuggcggcuacaugcugggaagugccaugagcaggcccaucauacauuucggcagugacuaugaggaccguuacuaucgugaaaacaugcaccguuaccccaaccaaguguacuacaggcccauggaugaguacagcaaccagaacaacuuugugcacgacugcgucaauaucacaaucaagcagcacacggucaccacaaccaccaagggggagaacuucaccgagaccgacguuaagaugauggagcgcgugguugagcagauguguaucacccaguacgagagggaaucucaggccuauuaccagagaggaucgagcaugguccucuucuccucuccaccugugauccuccugaucucuuuccucaucuuccugauagugggaugaggaaggucuuccuguuuucaccaucuuucuaaucuuuuuccagcuugagggaggcgguauccaccugcagcccuuuuagugguggugucucacucuuucuucucucuuugucccggauaggcuaaucaauacccuuggcacugaugggcacuggaaaacauagaguagaccugagaugcuggucaagcccccuuugauugaguucaucaugagccguugcuaaugccaggccaguaaaaguauaacagcaaauaaccauugguuaaucuggacuuauuuuuggacuuagugcaacagguugaggcuaaaacaaaucucagaacagucugaaauaccuuugccuggauaccucuggcuccuucagcagcuagagcucaguauacuaaugcccuaucuuaguagagauuucauagcuauuuagagauauuuuccauuuuaagaaaacccgacaacauuucugccagguuuguuaggaggccacaugauacuuauucaaaaaaauccuagagauucuuagcucuugggaugcaggcucagcccgcuggagcaugagcucuguguguaccgagaacuggggugauguuuuacuuuucacaguaugggcuacacagcagcuguucaacaagaguaaauauugucacaacacugaaccucuggcuagaggacauauucacagugaacauaacuguaacauauaugaaaggcuucugggacuugaaaucaaauguuugggaauggugcccuuggaggcaaccucccauuuuagauguuuaaaggacccuauauguggcauuccuuucuuuaaacuauagguaauuaaggcagcugaaaaguaaauugccuucuagacacugaaggcaaaucuccuuuguccauuuaccuggaaaccagaaugauuuugacauacaggagagcugcaguugugaaagcaccaucaucauagaggaugauguaauuaaaaaauggucagugugcaaagaaaagaacugcuugcauuucuuuauuucugucucauaauugucaaaaaccagaauuaggucaaguucauaguuucuguaauuggcuuuugaaucaaagaauagggagacaaucuaaaaaauaucuuagguuggagaugacagaaauaugauugauuugaaguggaaaaagaaauucuguuaauguuaauuaaaguaaaauuauucccugaauuguuugauauugucaccuagcagauauguauuacuuuucugcaauguuauuauuggcuugcacuuugugaguauucuauguaaaaauauauauguauauaaaauauauauugcauaggacagacuuaggaguuuuguuuagagcaguuaacaucugaagugucuaaugcauuaacuuuuguaagguacugaauacuuaauaugugggaaacccuuuugcgugguccuuaggcuuacaaugugcacugaaucguuucauguaagaauccaaaguggacaccauuaacaggucuuugaaauaugcauguacuuuauauuuucuauauuuguaacuuugcauguucuuguuuuguuauauaaaaaaauuguaaauguuuaauaucugacugaaauuaaacgagcgaagaugagcaccaaaaaaaaaaaaaaaa

SEQ ID NO: 289 - RNA, 3236 nt, Homo_Sapiens
gguuuccucccuuagcccgcugcccucaaucccagcgaggcuggggcuccggcucggcgcccccuuccucgcucccugguccggcgccccaugccgcccccgcccgguccccggcucccccagucccccacuuaggcgggcucacagaucccggggugcuggcgcgugggccgggggcgcguagggcgccugcagacggccccuggaagggcucugguggggcugagcgcucugccgcgggggcgcgggcacagcaggaagcagguccgcgugggcgcugggggcaucagcuaccggggugguccgggcugaagagccaggcagccaaggcagccaccccggggggugggcgacuuugggggaguuggugccccgccccccaggccuuggcggggucauggggcccccccauucugggccggggggcgugcgagucggggcccugcugcugcuggggguuuuggggcuggugucugggcucagccuggagccugucuacuggaacucggcgaauaagagguuccaggcagagggugguuaugugcuguacccucagaucggggaccggcuagaccugcucugcccccgggcccggccuccuggcccucacuccucuccuaauuaugaguucuacaagcuguaccugguagggggugcucagggccggcgcugugaggcacccccugccccaaaccuccuucucacuugugaucgcccagaccuggaucuccgcuucaccaucaaguuccaggaguauagcccuaaucucuggggccacgaguuccgcucgcaccacgauuacuacaucauugccacaucggaugggacccgggagggccuggagagccugcagggaggugugugccuaaccagaggcaugaaggugcuucuccgagugggacaaaguccccgaggaggggcugucccccgaaaaccugugucugaaaugcccauggaaagagaccgaggggcagcccacagccuggagccugggaaggagaaccugccaggugaccccaccagcaaugcaaccucccggggugcugaaggcccccugcccccucccagcaugccugcaguggcuggggcagcaggggggcuggcgcugcucuugcugggcguggcaggggcugggggugccauguguuggcggagacggcgggccaagccuucggagagucgccacccugguccuggcuccuucgggaggggagggucucugggccugggggguggaggugggaugggaccucgggaggcugagccuggggagcuagggauagcucugcgggguggcggggcugcagauccccccuucugcccccacuaugagaaggugaguggugacuaugggcauccuguguauaucgugcaggaugggcccccccagagcccuccaaacaucuacuacaagguaugagggcuccucucacguggcuauccugaauccagcccuucuuggggugcuccuccaguuuaauuccugguuugagggacaccucuaacaucucggcccccugugcccccccagccccuucacuccucccggcugcuguccucgucuccacuuuuaggauuccuuaggauucccacugccccacuuccugcccucccguuuggccaugggugccccccucugucucagugucccuggauccuuuuuccuuggggaggggcacaggcucagccuccucucugaccaugacccaggcauccuugucccccucacccacccagagcuaggggcgggaacagcccaccuuuugguuggcaccgccuucuuucugccucucacugguuuucucuucucuaucucuuauucuuucccucucuuccgucucuaggucuguucuucuucccuagcauccuccuccccacaucuccuuucacccucuuggcuucuuauccugugccucucccaucuccugggugggggcaucaaagcauuucuccccuuagcuuucagccccccuucugaccucucauaccaaccacuccccucagucugccaaaaaugggggccuuauggggaaggcucugacacuccaccccagcucaggccaugggcagcagggcuccauucucuggccuggcccaggccucuacauacuuacuccagccauuuggggugguugggucaugacagcuaccaugagaagaagugucccguuuuguccaguggccaauagcaagauaugaaccggucgggacauguauggacuuggucugaugcugaaugggccacuugggaccggaagugacuugcuccagacaagaggugaccaggcccggacagaaauggccugggaaguagcagaagcagugcagcaggaacuggaagugccuucauccaggacaggaaguagcacuucugaaacaggaaguggucuggcuggaacuccaaguggcuuagucugggggaucaggaggugggagguggaugguucuuauucuguggagaagaagggcgggaagaacuuccuuucaggaggaagcuggaacuuacugacuguaagagguuagagguggaccgagaaggacuuuucccagucuucaguggcacuucccaagaucucccuucccuugugcucugugcugauuuuaggacagcuaagaugacugccaugugcuguggcaggccuaauuugucuuguucuuuccuuuccauaucccaguauaaucucuguuaaucaacaggacuaccccaagaacccaugugcucucccgaguaacccagauggcugucuuguucauuccauccuacauuucugacuccuuucagacucaacacaguucccuucuuagugaccaaaaugguggccuacuggcuggucuagcugacagugguacuuagcaaaggccacuguuuccauagugaccagcugauaccucuuccugcccucuagugugcaauuggguguugccucaguuuccucccagcucaguuuuauuagaucaaagcuguuguugggcaccagguuggccaccucaaucaccagccaagaugguugcuuuguccaccagaggucaaguucaccucucuggugcuguaguucccagcuccuuccugauuuuucuaaucgcuccuucuggggaacaggaaguugauauugccaugguggcgggguaugccgucaccucaguaguuuuacuguaaaagggaaauuugaacaacaaaaaccaaaaaaaauaaaaauaaaaaacuucaaaaguugacaaaaaaaaaaaaaaaaaaa

SEQ ID NO: 290 - RNA, 6364 nt, Homo_Sapiens
cugggauagaagcggcaggagcagcguuggcaccggcgaaccauggcugggauuuucuauuucgcccuauuuucgugucucuucgggauuugcgacgcugucacagguuccaggguauaccccgcgaaugaaguuaccuuauuggauuccagaucuguucagggagaacuuggguggauagcaagcccucuggaaggagggugggaggaagugaguaucauggaugaaaaaaauacaccaauccgaaccuaccaagugugcaaugugauggaacccagccagaauaacuggcuacgaacugauuggaucacccgagaaggggcucagaggguguauauugagauuaaauucaccuugagggacugcaauagucuuccgggcgucauggggacuugcaaggagacguuuaaccuguacuacuaugaaucagacaacgacaaagagcguuucaucagagagaaccaguuugucaaaauugacaccauugcugcugaugagagcuucacccaaguggacauuggugacagaaucaugaagcugaacaccgagauccgggauguagggccauuaagcaaaaagggguuuuaccuggcuuuucaggaugugggggccugcaucgcccugguaucaguccguguguucuauaaaaaguguccacucacaguccgcaaucuggcccaguuuccugacaccaucacaggggcugauacgucuucccugguggaaguucgaggcuccugugucaacaacucagaagagaaagaugugccaaaaauguacuguggggcagauggugaauggcugguacccauuggcaacugccuaugcaacgcugggcaugaggagcggagcggagaaugccaagcuugcaaaauuggauauuacaaggcucucuccacggaugccaccugugccaagugcccaccccacagcuacucugucugggaaggagccaccucgugcaccugugaccgaggcuuuuucagagcugacaacgaugcugccucuaugcccugcacccguccaccaucugcuccccugaacuugauuucaaaugucaacgagacaucugugaacuuggaauggaguagcccucagaauacagguggccgccaggacauuuccuauaaugugguaugcaagaaauguggagcuggugaccccagcaagugccgacccuguggaagugggguccacuacaccccacagcagaauggcuugaagaccaccaaagucuccaucacugaccuccuagcucauaccaauuacaccuuugaaaucugggcugugaauggaguguccaaauauaacccuaacccagaccaaucaguuucugucacugugaccaccaaccaagcagcaccaucauccauugcuuugguccaggcuaaagaagucacaagauacaguguggcacuggcuuggcuggaaccagaucggcccaaugggguaauccuggaauaugaagucaaguauuaugagaaggaucagaaugagcgaagcuaucguauaguucggacagcugccaggaacacagauaucaaaggccugaacccucucacuuccuauguuuuccacgugcgagccaggacagcagcuggcuauggagacuucagugagcccuuggagguuacaaccaacacagugccuucccggaucauuggagauggggcuaacuccacaguccuucuggucucugucucgggcaguguggugcuggugguaauucucauugcagcuuuugucaucagccggagacggaguaaauacaguaaagccaaacaagaagcggaugaagagaaacauuugaaucaagguguaagaacauauguggaccccuuuacguacgaagaucccaaccaagcagugcgagaguuugccaaagaaauugacgcauccugcauuaagauugaaaaaguuauaggaguuggugaauuuggugagguaugcagugggcgucucaaagugccuggcaagagagagaucuguguggcuaucaagacucugaaagcugguuauacagacaaacagaggagagacuuccugagugaggccagcaucaugggacaguuugaccauccgaacaucauucacuuggaaggcguggucacuaaauguaaaccaguaaugaucauaacagaguacauggagaauggcuccuuggaugcauuccucaggaaaaaugauggcagauuuacagucauucagcuggugggcaugcuucguggcauugggucugggaugaaguauuuaucugauaugagcuaugugcaucgugaucuggccgcacggaacauccuggugaacagcaacuuggucugcaaagugucugauuuuggcaugucccgagugcuugaggaugauccggaagcagcuuacaccaccagggguggcaagauuccuauccgguggacugcgccagaagcaauugccuaucguaaauucacaucagcaagugauguauggagcuauggaaucguuaugugggaagugaugucguacggggagaggcccuauugggauauguccaaucaagaugugauuaaagccauugaggaaggcuaucgguuacccccuccaauggacugccccauugcgcuccaccagcugaugcuagacugcuggcagaaggagaggagcgacaggccuaaauuugggcagauugucaacauguuggacaaacucauccgcaaccccaacagcuugaagaggacagggacggagagcuccagaccuaacacugccuuguuggauccaagcuccccugaauucucugcugugguaucagugggcgauuggcuccaggccauuaaaauggaccgguauaaggauaacuucacagcugcugguuauaccacacuagaggcuguggugcacgugaaccaggaggaccuggcaagaauugguaucacagccaucacgcaccagaauaagauuuugagcaguguccaggcaaugcgaacccaaaugcagcagaugcacggcagaaugguucccgucugagccaguacugaauaaacucaaaacucuugaaauuaguuuaccucauccaugcacuuuaauugaagaacugcacuuuuuuuacuucgucuucgcccucugaaauuaaagaaaugaaaaaaaaaaacaauaucugcagcguugcuuggugcacagauugcugaaacuguggggcuuacagaaaugacugccggucauuugaaugagaccuggaacaaaucguuucucagaaguacuuuucuguucaucaccagucuguaaaauacauguaccuauagaaauagaacacugccucugaguuuugaugcuguauuugcugccagacacugagcuucugagacaucccugauucucucuccauuuggaauuacaaccauuguauuuuguuuguggcauaaauuacagucaucugucuuucacuggaaugaagaccaugccuaggaacauuuuuuaaggacucagcuguggcuuuuagggcuugguucauaccaugggggaaaaaaaaguccuaggagaaagcgacguggcucauuaguguugccucuucagugcucaagccgccugguggauuccuaugacacagggggccuggaaagaaagggaaaguggauuuaaaauauauauauacguaacccaagccccauaaccccuaacuggacaaaugaggucuguuucuuugggccugaggcugugccauauaaagucuuauuuugggacuuuacaaacuuguccuaacuaucuuguggauagugggcugugacaaucuggaauagagaacguucacacuucgcuccuuuaaagaagcgaccccagaucugcaagggaguagauucugcuaucuuggccucacagcccuuccuguugauuacaaagcccguggaagaaaacagaacacacccuccucaguuccgucuaaauguguuucuucugcuucaauuacaccaguucuggggcaaagacacugaugaaacaacacccauaccugaaaagaauaaaugugugacuuucaaauccccuuucgcagugaaagaaacagcaaacacuuaagauucagcaucuguucuccaguugcacugaggaaugcacugucucgcagcaccagcucugcagagcccuugccccagacucuuugcgguuuuauuuauauguauuuccauauuucauuccugugugucacugcugcauugguguggcagcaagugaccaaaugcuacaggucuuacuauggacaccaggucaggugcaaccacacaaaacaaagccaguuccaugagcugccuaugauaugcauugcggaaguaacauuuuacccagggugugccauugcagugauauaaauauauuuuuuucuuagacuaaauaugagcugacuaucucuuuugauguguguacauaggugugaguguguguguaugcgugccugucugugugcggguguguguaugugcauagccucaugcuuaggacuacccaugaauguuguggaaugcuacaccuggagaguucugguuuuccaccaguuucaagaugaagaacuacaugauacaguggaccuggagaccauccccuuggaaagacaacccagagauguucagcauccuguaucuacacgcauccuguaucuacacguguauuuuguagcugucacacuaaccuuaauaagaauucuacagcuuuggacagaggcauuuucaccuuaauggugaaguaauuuaaaauauaaauccauucaggugacaacccaucaucaaaauuacaaauuuucugauugaacucaucugaaucaucaguuccuugauggagagagagaaggagauggaaugugucugguaaccccaaauggaguacaaguagccuuuguuuuccugcauaaauggacuuguugaaugcgaacgaauauaugcaauucauauacuuuuggagaugaacguagauaugugugucagcuuugagaugguguguccuggauuaauacuuugucucccaauaucacagaaaaauacaugccagugacucuugagguuaagguaguugggaugaaauggccucaggcaauuucacauucccuaauuaccuggaaaguucuacaguaauuaauaugcagcuaacuccuguugcccucacaagagcaucagccuucuagaaucggagcuccggagugugaagauucaguauugauaugauauguauaccaaacuccagccaacuuacugccauuuuucauaaucugaguggcugccuugcuuauccuaagcugugguugcagaaaccguggccauuuauauaagcuauaacaucaaaucagggaaaaaugaggaaaaaaaauagauucugaaccauuuauuguugaauaaguagagaaaaucaucaauaaauauuuauuacauucugacaggguguguggcauuguguucuaugccagagugacaaaguugauucaccccuuuuuggggaccuuaauauauuuuuuaagggaugugccuaugcauugaugccugaaaaauauguauaaagaaaugagguugacucuucugagcaguucaucuuuuccagagguaaggguaggaggccaacuucagggucugggucugagcccgugggcaagcccuggccgagugagcuccaaugcuaacucaugugccgaucucuagagcagugggaaacuaccccgcugcaccaaaucaaguagcuucaccuuguguaugcaggccccaaguuauuuuuuagcaaucuuacgagugaaauguucugguggguugaaaaacguucuuauuuuaaagaaagguugugcucgcuacacugcuggugugugcauucugagaccucuuguauucaaucugugaaggauauguguauuaauccguacacccguauagccucaauauuugucugaagacacuuaaauucugacccauaaaggaaaguucuagaagcaauauuuucacuuauuuaacauucuccaaacaacaucaagcauugauacacacugaagagugcguuuauuuuuuguaucacucuaaguauguuggaauaugcaaggacugugguucaaauuagaauguauaaggcauauuauaauuuaguucauacugaauaagaaauuaacagaacauuguucgguucacacguuccaaacuuugagugauuucuggaguuagacauagauuuucuauuuuguuuuaauuugucaagguauuuuucuucccuucaugaacuuuagguacacauaacuuaugucauuuauuuauggucuuuuauaccuaguuuguaaaauuguaaaauagcaaacuaaaugcaaagaguuugcauuugaaaauaauaaaguaguugccguauacaacccugcaaaaaaaaaaaaaaaaaa

SEQ ID NO: 291 - RNA, 5335 nt, Homo_Sapiens
gcuucucuccaucuugugauuccuuuuuccuccugaacccuccagugggggugcgaguuugucuuuaucaccccccaucccaccgccuucuuuucuucucgcucuccuaccccuccccagcuuggugggcgccucuuuccuuucucgcccccuuucauuuuuauuuauucauauuuauuuggcgcccgcucucucucugucccuuugccugccucccucccuccggauccccgcucucuccccggaguggcgcgucgggggcuccgccgcuggccaggcgugauguugcacguggagauguugacgcugguguuucuggugcucuggauguguguguucagccaggacccgggcuccaaggccgucgccgaccgcuacgcugucuacuggaacagcagcaaccccagauuccagaggggugacuaccauauugaugucuguaucaaugacuaccuggauguuuucugcccucacuaugaggacuccgucccagaagauaagacugagcgcuauguccucuacauggugaacuuugauggcuacagugccugcgaccacacuuccaaaggguucaagagaugggaauguaaccggccucacucuccaaauggaccgcugaaguucucugaaaaauuccagcucuucacucccuuuucucuaggauuugaauucaggccaggccgagaauauuucuacaucuccucugcaaucccagauaauggaagaagguccugucuaaagcucaaagucuuugugagaccaacaaauagcuguaugaaaacuauagguguucaugaucguguuuucgauguuaacgacaaaguagaaaauucauuagaaccagcagaugacaccguacaugagucagccgagccaucccgcggcgagaacgcggcacaaacaccaaggauacccagccgccuuuuggcaauccuacuguuccuccuggcgaugcuuuugacauuauagcacagucuccucccaucacuugucacagaaaacaucagggucuuggaacaccagagauccaccuaacugcucauccuaagaagggacuuguuauuggguuuuggcagaugucagauuuuuguuuucuuucuuucagccugaauucuaagcaacaacuucagguugggggccuaaacuuguuccugccucccucaccccaccccgccccacccccagcccuggcccuuggcuucucucaccccucccaaauuaaauggacuccagaugaaaaugccaaauugucauagugacaccagugguucgucagcuccugugcauucuccucuaagaacucaccuccguuagcgcacugugucagcgggcuauggacaaggaagaauaguggcagaugcagccagcgcuggcuagggcugggaggguuuugcucuccuaugcaauauuuaugccuucucauucagaacuguaagaugaucgcgcagggcaucaugucaccaugucagguccggaggggagguauuaagaauagauacgauauuacaccauuuccuauaggaguauguaaaugaacaggcuucuaaaagguugagacacugguuuuuuuuuuuaauaugacugucuuaaagcauucuugacagcaaaacuugugcucucuaaaagaagccuuuuuuuuuuuucuaggaggcagguuggguguggaaugcuaauacagagcaggugugaaaacagagaaaacuacagguuugcuggggguguguaugugugagugccucuaauuuuuuuggugacugggcagugcacaccagauauuuuuucuuugaauacagaucaccauggugcuacaacuuuuuuuuuuuuuuuuuuuuuuuuuuuuuuuuuuuuuaagaaacucaaagaggcauuuuuaugaauaaagugaccuuccccaaggcugacaagccaggguugaugagugcauaguggaauagcuuuggauacuccucugggggaugacauguaccaaggagaggaccgcaguggccagaggagacaugauuuggcuuugcuggagcgccagugugcuguggccuuuccccgccucccacccuaguacccacguuuugcuccacacuccuugaccgcaggggcucggacacaaaccccugucaccaggagagucagucagcacuacuugggagggcuaaagggaaauuuggaaauaaaauuccaaaguuuggaguaaaaaaauucaaguguugauuuuauauucuuucccuuucugacacagccuaaagcguagggggaacauguguuuaucugugggagauaaacaagauggagucccaaagacuuuaacaaaauauuuuuuuaaaaauccacuagaauagaaaauacauuauuuagauauacuuuaugcugagagugaguauauaugcuuguccuauuuaaacuugugagaaaaagugguaucccuugauacauuuagaaauaugggggcuaucuuguuucauuguggggguggggcagaaggagaauaaaugcaggaugacccuguugaaggaaucuuagcauggccaacaggggacguuuccagucgauuaccaggaaaugcaagccuugggguuucuacuggugguggggcugucaugaacuuuaaaauccaaagccuagacaaggaaaaguguuagaccaauugaaaagcaauccagcccuuuuuuuuuuuuuuuuuuuggcuuugcacgacaugucaacagaaaccaugccuuucaauauaagaaauaaaugugaugaucauguaaaaugugaaaaauugaaagcauuccagcaaaauaagaauuuuuuauauauuuguuuuuuaagauguauauguuaaaaaaagagaaggucgcauuauggacagacuucgugaaugggaauuugcuuagaauugugaguaguucugaauuagaaaaguaugugaaggaaaggcagcuguaaacguauugugcccuggagaguuguacacauguugaaauguaaucugggcuuaccugauccauuuggaguggaugucacugccgagucuguucucacauggaaccaugugugugggguugccagccucacagauacaaucaauccuauuccccucugacauaaggaacuccucuggaguggcagagucuuaucacagaaggcagccaccauuucaccaaaacaaaaguucacggcauucaauuccuuuuuccuuuagcuauuuauauaugcaguacucucagucauaugcagaaauacuuuuuuuuuuuuaauuaauaguuacaggcuuguugguccagugggauuuggguagggggagaaagauaccuucuaaaauggaucaauagaaccaaaauaauacagcauguucuauaaccacaaggaaaucaaaugauccugucaugauuccaguuagucauaacuauguuagcagugcuaaaugcauuuuagaaauggugacuucugugguuuuccuagcauuugucucuaacaaauggugaaauaauuacucauggcccucucugccauugucuuucauuuuuucacagugaaauuagaccccuuuacuucaccauucugccacugcaaauuaaguauaaagaaaauagcaagaguguccacaccaguagacaguaagcuucucuaccuguaagugaugaaaucauagcuaaugcacuugccauggaguuuucaagaugauuggugucagacaguuuucacuuuguuuaaaaaguguugguggccuuuuguggugguguuacaauccucugggggcuuaggaggauguugaugcaacuuuuagaagcuuuuaauuucaaaaacaacucaaaaaucugaaggacagucauagcugccacucagccccaguuagucaaaccccagugaccuuugccccugguugccaagggcuuugcaacaucaagcagggaaauaaggaucugucuguuuaguggauaccguguauccuuuaauagaccagguaacaguucguguuaguuuagacuauuguuuuguacuguacuuucuuggguggcagaggaaagaaaaguaaaacauuaaaaaaaaaaaaaaaacugcguucuuuaaauucuguauuauuagcaaccucuguuguacauaguguuugauaauaaaguauuaauuugauucuuaugucuuuuguaagugagaacaauagacuuucaggauacaaaacaugcauugaggcuuugaaacauccaauguguaccauggcugaaaaaaagagucacaaguggcugagacacugcuccauacaggacucauguguggucauugcccacccaaucuuaugacuccaucaucuugggaccuggaacaacaugacuuuuuugaucgauauuuuguccucgguguuuucaaggucugauguuggagcccuguggcccacccucccuucuccaccagcauguugguuugaaaaggauagggaauuuagaaacaguucuguacuuugguuugguuugguuuucuguuugugauuguuuucauggacuguuuuauuuuuucccaggaagagucuuuaucaauaucaugugcagcucacucauggaaaugguugcaaaccaaucaguguaggaagcuuaaauggggcuguuucccucucugugucguugugaaaggaagagucacacaguaccuguggauuuucagggacucuguuuuucuccggugccuuagcaacggcagcagccauuuguauuauuuucaaauaauuagaaaaacaguuuucaacuccuccuuuccauucauugcucucagaguuguggucacugacuuuucuuuugaaaaccgccuccaccaacacccccguuugccuacaccaccccccuuuuacuuaguauguuuauuuuuugugugucucuugccuuccucccacguuuuauuuccccucagagcugugaaugggcaggucugucucugguuuggcaucacugaguuuuucccaugcauuggccccagggcugcuaggaugugagacaaaucucccuacaaugggcuugcucccauugucuguacaguuuaauagaugcuggcaugucggagguuacccaugagucaaaauccgcucuccaugcuuacucuugacaccccauugaagccacucauugugugugcgucugggugugaaguccagcuccgugugguccugugcuuguacugcccugcuuugcaguuccuuugcacuuacucaucgagugcuguuuugaaaugcugacauuauauaaacguaaaagaaaauguaaaaaaaaaaaacccacacacaaacaaacccauacgaucuguauuuguauauacacguguccguacaaguauaacuaaauaaaaauuaaagauuuucaucauuuuaauugga

SEQ ID NO: 292 - RNA, 6644 nt, Homo_Sapiens
auuggaguguggagcaagcggccggucugcagucggagacuugcaggcagcaaacacggugcgagcgaacaggagugggggggaaauuaaaaaaagcuaaacguggagcagccgaucggggaccgagaaggggaaucgaugcaaggagcacaauaaaacaaaagcuacuucggaacaaacagcauuuaaaaauccacgacucaagauaacugaaaccuaaaauaaaaccugcucaugcaccaugguuuuucaaacucgguacccuucauggauuauuuuaugcuacaucuggcugcuccgcuuugcacacacaggggaggcgcaggcugcgaaggaaguacuacugcuggauucuaaagcacaacaaacagaguuggaguggauuuccucuccacccaaugggugggaagaaauuagugguuuggaugagaacuauaccccgauacgaacauaccaggugugccaagucauggagcccaaccaaaacaacuggcugcggacuaacuggauuuccaaaggcaaugcacaaaggauuuuuguagaauugaaauucacccugagggauuguaacagucuuccuggaguacugggaacuugcaaggaaacauuuaauuuguacuauuaugaaacagacuaugacacuggcaggaauauaagagaaaaccucuauguaaaaauagacaccauugcugcagaugaaaguuuuacccaaggugaccuuggugaaagaaagaugaagcuuaacacugaggugagagagauuggaccuuuguccaaaaagggauucuaucuugccuuucaggauguaggggcuugcauagcuuugguuucugucaaaguguacuacaagaagugcugguccauuauugagaacuuagcuaucuuuccagauacagugacugguucagaauuuuccucuuuagucgagguucgagggacaugugucagcagugcagaggaagaagcggaaaacgcccccaggaugcacugcagugcagaaggagaaugguuagugcccauuggaaaauguaucugcaaagcaggcuaccagcaaaaaggagacacuugugaacccuguggccguggguucuacaagucuuccucucaagaucuucagugcucucguuguccaacucacaguuuuucugauaaagaaggcuccuccagaugugaaugugaagauggguauuacagggcuccaucugacccaccauacguugcgugcacaaggccuccaucugcaccacagaaccucauuuucaacaucaaccaaaccacaguaaguuuggaauggaguccuccugcagacaaugggggaagaaacgaugugaccuacagaauauuguguaagcggugcaguugggagcagggcgaauguguucccugugggaguaacauuggauacaugccccagcagacuggauuagaggauaacuaugucacugucauggaccugcuagcccacgcuaauuauacuuuugaaguugaagcuguaaauggaguuucugacuuaagccgaucccagaggcucuuugcugcugucaguaucaccacuggucaagcagcucccucgcaagugaguggaguaaugaaggagagaguacugcagcggagugucgagcuuuccuggcaggaaccagagcaucccaauggagucaucacagaauaugaaaucaaguauuacgagaaagaucaaagggaacggaccuacucaacaguaaaaaccaagucuacuucagccuccauuaauaaucugaaaccaggaacaguguauguuuuccagauucgggcuuuuacugcugcugguuauggaaauuacagucccagacuugauguugcuacacuagaggaagcuacagguaaaauguuugaagcuacagcugucuccagugaacagaauccuguuauuaucauugcugugguugcuguagcugggaccaucauuuugguguucauggucuuuggcuucaucauugggagaaggcacugugguuauagcaaagcugaccaagaaggcgaugaagagcuuuacuuucauuuuaaauuuccaggcaccaaaaccuacauugacccugaaaccuaugaggacccaaauagagcuguccaucaauucgccaaggagcuagaugccuccuguauuaaaauugagcgugugauuggugcaggagaauucggugaagucugcaguggccguuugaaacuuccagggaaaagagauguugcaguagccauaaaaacccugaaaguugguuacacagaaaaacaaaggagagacuuuuugugugaagcaagcaucauggggcaguuugaccacccgaauguuguccauuuggaagggguuguuacaagagggaaaccagucaugauaguaauagaguucauggaaaauggagcccuagaugcauuucucaggaaacaugaugggcaauuuacagucauucaguuaguaggaaugcugagaggaauugcugcuggaaugagauauuuggcugauaugggauauguucacagggaccuugcagcucgcaauauucuugucaacagcaaucucguuuguaaagugucagauuuuggccugucccgaguuauagaggaugauccagaagcugucuauacaacuacugguggaaaaauuccaguaagguggacagcacccgaagccauccaguaccggaaauucacaucagccagugauguauggagcuauggaauagucaugugggaaguuaugucuuauggagaaagaccuuauugggacaugucaaaucaagauguuauaaaagcaauagaagaagguuaucguuuaccagcacccauggacugcccagcuggccuucaccagcuaauguuggauuguuggcaaaaggagcgugcugaaaggccaaaauuugaacagauaguuggaauucuagacaaaaugauucgaaacccaaauagucugaaaacuccccugggaacuuguaguaggccaauaagcccucuucuggaucaaaacacuccugauuucacuaccuuuuguucaguuggagaauggcuacaagcuauuaagauggaaagauauaaagauaauuucacggcagcuggcuacaauucccuugaaucaguagccaggaugacuauugaggaugugaugaguuuagggaucacacugguuggucaucaaaagaaaaucaugagcagcauucagacuaugagagcacaaaugcuacauuuacauggaacuggcauucaagugugauaugcauuucucccuuuuaagggagauuacagacugcaagagaacaguacuggccuucaguauaugcauagaaugcugcuagaagacaagugauguccuggguccuuccaacagugaagagaagauuuaagaagcaccuauagacuugaacuccuaagugccaccagaauauauaaaaagggaauuuaggauccaccaucgguggccaggaaaauagcagugacaauaaacaaaguacuaccugaaaaacauccaaacaccuugagcucucuaaccuccuuuuugucuuauagacuuuuuaaaauguacauaaagaauuuaagaaagaauauauuugucaaauaaaaucaugaucuuauuguuaaaauuaaugaaauauuuuccuuaaauaugugauuucagacuauuccuuuuuaaaaucauuuguguuuauucuucauaaggacuuuguuuuagaaagcuguuuauagcuuuggaccuuuuuaguguuaaaucuguaacauuacuacacuggguaccuuugaaagaaucucaaauuucaaaagaaauagcaugauugaagauacaucucuguuagaacauugguauccuuuuugugccauuuuauucuguuuaaucagugcuguuuugauauuguuugcuaauuggcagguagucaagaaaaugcaaguugccaagagcucugauauuuuuuaaaaagaauuuuuuuguaaagaucagacaacacacuaucuuuucaaugaaaaaagcaauaaugauccauacauacuauaaggcacuuuuaacagauuguuuauagagugauuuuacuagaaagaauuuaauaaacucgaaguuuagguuuaugaguauauaaacaaaugaggcacuucaucugaagaauguuggugaaggcaagucucugaaagcagaacuauccaguguuaucuaaaaauuaaucugagcacaucaagauuuuuucauucucgugacauuaggaaauuuaggauaaauaguugacauauauuuuauauccucuucuguugaaugcaguccaaacaugaaaggaaauaauuguuuuauauuauaacucugaagcaugauaaaggggcaguucacaauuuucaccauuuaaacacaaauuugcugcacagaauaucaccauugcaguucaaaacaaaacaaaacaaaaagucuuuuguuugugaacacugaugcaagaaacuuguuaaaugaaaggacucuuuacccuagaaggaagaggugaaggaucuggcuuguuuuuaaagcuuuauuuauuaaaccauauuauuugauuacuguguuagaauuucauaagcaauaauuaaaugugucuuuauagauauugcaggaauguauacauauugugauuaaugcuuucaaaacuuaugaaaaucaugaacuaccccagaauugaacuguuguacuuccaaagagaauugggcuguuuauaaugauuuuaauagagaaagaucccagggaucggucauaauuggucuuguuugauaaugugggcauccacaaacaaacaaacaaauaacagaaacaaaaucuguaaauguuccuuuguaaaacuuguaaauuuuauuuauacugucuuguuuuguacacacauuucucuguagugggcucugaauacauugaaaaugcacuauauuuuucuauuuuacuugcagagcaucacaaaagaacagguauuuucagugcuacauaauguguuuucccacauuuaggaccaaagacggcuauagaaaaacucaaauggauugcuucccaaaccccuccccacccuuuuuuuuugguuuuaaaucacuguacaguguuauuugauauuuuaauuuauuuuuugauugacuagaaaaaucauuuuaauuucacuaaaauguuuuuugucccuaaggaaaaguaaucuguaaaaauaauuuuaauuagcauaauacagucaccuagacacuuccauuuguaaucuuuguaauagacuguaaauauauuuuuggaacuauaacacaaugugcuugaggguuauuuuucagugucugcaguguguacaaguguuuauacuaaguccagcacuuuacaauucuaaucaguagcauuggccuuugugagaaugagugaaagaguuugagugaguguucuuaauuccuuuuggauucuagacucacuaauaaugaaguucuuuucuuguucauagcuuaaggugcuuauuuuuucuauuaaaauuaaauuaacaaaagccauucuagaaauagaagacauaguaugguacaugcaaacggugucuuuccugcuuuuuucuagcacuagauuuauaguugaguagucuuucuugaguagaagggcagaauaaaaguuuuuuugaguuuuuuucaaaaauaaauuuuuccuucagcaauauaccucaucugccuuaaauuuuuuacagcucuuuacagggaaaggggagaagggaugggaaagacacacagcacaauaggaaguguaugauuacaucacuaucucguuuguaaguuucuuuuccuaaucaacauuaugauuucgaaauacauguaugugaaacaaauauuaagagaaaaagaauuaacauuguaaugcugauuguaauacucucuuccagaaagagaugagaugguauaacgauaagaauguacaacuugcaccuugaaaucuuuuuuuuuaaauaaauuagugcucaggggaggaaaaguagagaaagugaacgucaaaaauagaauuccaaaauuauaaaaaugcaaaaggaaauggccuccuugcuuuaauagagccaccuuuuuuagaacacuguccucacacuugaccuguguuuugcauucaguacugaaauaaaaguaacuuguucuacauuugaaucuaacauuuucucagcaauugaucugguccuuguuuacuagaacuggugguuuaugcuugucagagcacuauuaguugaaucauauuguauacuuauguaaucuacauuagcuaguacuguuuaggacuauauuuuaauugcucuucuuauccguguuuuuaagacaauuaaaauggugugauucaccucucuuuuuuauuuagguaaugcugauauucucccuuuuguuucuugaguagccuagaacuaugcuacucacugaugugcauguucaaauaaauuacugauguguauuuuuuugcuauauguggagaaaucauggggaacucggggcgagaugugcuuuucguugguugaauuugucccuccuugccuaagaaauacuacaggggucauccuuuuauaaggacaaacugcuuuugaacagugucuucaauguaucaagcacaaauaacucuuucuucaacaugaaucauaagucucuuuuuaccagcuuaaaauaauaaacaagucuauuagacaauguaaagaaaa

SEQ ID NO: 293 - RNA, 4335 nt, Homo sapiens
gcgcggagcugggaguggcuucgccauggcugugagaagggacuccguguggaaguacugcugggguguuuugaugguuuuaugcagaacugcgauuuccaaaucgauaguuuuagagccuaucuauuggaauuccucgaacuccaaauuucuaccuggacaaggacugguacuauacccacagauaggagacaaauuggauauuauuugccccaaaguggacucuaaaacuguuggccaguaugaauauuauaaaguuuauaugguugauaaagaccaagcagacagaugcacuauuaagaaggaaaauaccccucuccucaacugugccaaaccagaccaagauaucaaauucaccaucaaguuucaagaauucagcccuaaccucuggggucuagaauuucagaagaacaaagauuauuacauuauaucuacaucaaaugggucuuuggagggccuggauaaccaggagggaggggugugccagacaagagccaugaagauccucaugaaaguuggacaagaugcaaguucugcuggaucaaccaggaauaaagauccaacaagacguccagaacuagaagcugguacaaauggaagaaguucgacaacaagucccuuuguaaaaccaaauccagguucuagcacagacggcaacagcgccggacauucggggaacaacauccucgguuccgaaguggccuuauuugcagggauugcuucaggaugcaucaucuucaucgucaucaucaucacgcuggugguccucuugcugaaguaccggaggagacacaggaagcacucgccgcagcacacgaccacgcugucgcucagcacacuggccacacccaagcgcagcggcaacaacaacggcucagagcccagugacauuaucaucccgcuaaggacugcggacagcgucuucugcccucacuacgagaaggucagcggggacuacgggcacccgguguacaucguccaggagaugcccccgcagagcccggcgaacauuuacuacaaggucugagagggacccuggugguaccugugcuuucccagaggacaccuaaugucccgaugccucccuugaggguuugagagcccgcgugcuggagaauugacugaagcacagcaccgggggagagggacacuccuccucggaagagcccgucgcgcuggacagcuuaccuagucuuguagcauucggccuuggugaacacacacgcucccuggaagcuggaagacugugcagaagacgcccauucggacugcugugccgcgucccacgucuccuccucgaagccaugugcugcggucacucaggccucugcagaagccaagggaagacagugguuuguggacgagagggcugugagcauccuggcaggugccccaggaugccacgccuggaagggccggcuucugccuggggugcauuucccccgcagugcauaccggacuugucacacggaccucgggcuaguuaaggugugcaaagaucucuagaguuuaguccuuacugucucacucguucuguuacccagggcucugcagcaccucaccugagaccuccacuccacaucugcaucacucauggaacacucaugucuggaguccccuccuccagccgcuggcaacaacagcuucaguccauggguaauccguucauagaaauuguguuugcuaacaaggugcccuuuagccagaugcuaggcugucugcgaagaaggcuaggaguucauagaagggaguggggcuggggaaagggcuggcugcaauugcagcucacugcugcugccucugaaacagaaaguuggaaaggaaaaaagaaaaaagcaauuagguagcacagcacuuugguuuugcugagaucgaagaggccaguaggagacacgacagcacacacaguggauuccagugcauggggaggcacucgcuguuaucaaauagcgaugugcaggaagaaaagccccucuucauuccggggaacaaagacggguauuguugggaaaggaacaggcuuggagggaagggagaaaguaggccgcugaugauauauucgggcaggacuguugugguacuggcaauaagauacacagcuccgagcuguaggagagucggucugcuuuggaugauuuuuuaagcagacucagcugcuauacuuaucacauuuuauuaaacacagggaaagcauuuaggagaauagcagagagccaaaucugaccuaaaaguugaaaagccaaaggucaaacaggcuguaauuccaucaucaucguuguuauuaaagaauccuuaucuauaaaagguaggucagaucccccuccccccagguuccuccuuccccucccgauugagccuuacgacacuuugguuuaugcggugcuguccgggugccagggcugcagggucgguacugauggaggcugcagcgcccggugcucugugucaaggugaagcacauacggcagaccucuuagaguccuuaagacggaaguaaauuaugauguccagggggagaaggaagauaggacguauuuauaauagguauauagaacacaagggauauaaaaugaaagauuuuuacuaauauauauuuuaagguugcacacaguacacaccagaagaugugaaauucauuuguggcaauuaaguggucccaaugcucagcgcuuaaaaaaacaaauuggacagcuacuucugggaaaaacaacaucauuccaaaaagaacaauaaugagagcaaaugcaaaaauaaccaaguccuccgaaggcaucucacggaaccguagacuaggaaguacgagccccacagagcaggaagccgaugugacugcaucauauauuuaacaaugacaagauguuccggcguuuauuucugcguuggguuuucccuugccuuaugggcugaaguguucucuagaauccagcaggucacacugggggcuucaggugacgauuuagcuguggcucccuccuccuguccucccccgcacccccucccuucugggaaacaagaagaguaaacaggaaaccuacuuuuuaugugcuaugcaaaauagacaucuuuaacauaguccuguuacuaugguaacacuuugcuuucugaauuggaagggaaaaaaaauguagcgacagcauuuuaagguucucagaccuccagugaguaccugcaaaaaugaguugucacagaaauuaugauccucuauuuccugaaccuggaaaugauguugguccaaagugcguguguguaugugugagugggugcgugguauacauguguacauauauguauaauauauaucuacaauauauauuauauauaucuauaucauauuucuguggaggguugccaugguaaccagccacaguacauauguaauucuuuccaucaccccaaccucuccuuucugugcauucaugcaagaguuucuuguaagccaucagaaguuacuuuuaggaugggggagaggggcgagaaggggaaaaaugggaaauagucugauuuuaaugaaaucaaauguauguaucaucaguuggcuacguuuugguucuaugcuaaacugugaaaaaucagaugaauugauaaaagaguucccugcaaccaauugaaaaguguucugugcgucuguuuugugucuggugcagaauaugacaaucuaccaacugucccuuuguuugaaguugguuuagcuuuggaaaguuacuguaaaugccuugcuuguaugaucgucccuggucacccgacuuuggaauuugcaccaucauguuucagugaagaugcuguaaauagguucagauuuuacugucuauggauuugggguguuacaguagccuuauucaccuuuuuaauaaaaauacacaugaaaacaagaaagaaauggcuuuucuuacccagauuguguacauagagcaauguugguuuuuuauaaagucuaagcaagauguuuuguauaaaaucugaauuuugcaauguauuuagcuacagcuuguuuaacggcagugucauuccccuuugcacuguaaugaggaaaaaaugguauaaaagguugccaaauugcugcauauuugugccguaauuauguaccaugaauauuuauuuaaaauuucguuguccaauuuguaaguaacacaguauuaugccugaguuauaaauauuuuuuucuuucuuuguuuuauuuuaauagccugucauagguuuuaaaucugcuuuaguuucacauugcaguuagccccagaaaaugaaauccgugaagucacauuccacaucuguuucaaacugaauuuguucuuaaaaaaauaaaauauuuuuuuccuauggaaaaaaaaaaaaaaaaaa

The invention claimed is:

1. A method of providing ocular neuroprotection or for preventing, treating or alleviating the effects of, an ocular disease associated with retinal ganglion cell death in a subject, comprising applying to the external ear of the subject an amount of an otic composition comprising:
    at least one double-stranded RNA compound which down regulates expression of a target gene in the retina of the subject, wherein expression of said target gene is associated with retinal ganglion cell death; and
    a penetration enhancer which enhances the penetration of said double-stranded RNA compound through the skin and/or tympanic membrane in the ear of the subject;
the amount of the RNA compound in the otic composition being sufficient to reduce the expression of said target gene in the retina, and to inhibit retinal ganglion cell death so as to thereby provide neuroprotection or prevent, treat or alleviate the effects of, said ocular disease.

2. The method of claim 1, wherein the ocular disease comprises visual field loss.

3. The method of claim 1, wherein the ocular disease comprises neurodegeneration, increased intraocular pressure, an ischemic event or optic nerve injury.

4. The method of claim 3, wherein the ocular disease comprises injury to the retina or optic nerve injury.

5. The method of claim 4, wherein the injury to the retina or optic nerve injury comprises ischemia or hypoxia injury.

6. The method of claim 1, wherein the ocular disease is selected from the group consisting of glaucoma, diabetic retinopathy (DR), diabetic macular edema (DME), age related macular degeneration (AMD), Leber's hereditary optic neuropathy (LHON), Leber optic atrophy, optic neuritis, retinal artery occlusion, central retinal vein occlusion, brunch retinal vein occlusion, ischemic optic neuropathy, optic nerve injury, retinopathy of prematurity (ROP) or retinitis pigmentosa (RP), retinal ganglion degeneration, macular degeneration, hereditary optic neuropathy, metabolic optic neuropathy, optic neuropathy due to a toxic agent, neuropathy caused by adverse drug reactions or vitamin deficiency, and vision loss associated with a tumor.

7. The method of claim 6, wherein the ocular disease is glaucoma.

8. The method of claim 7, wherein the glaucoma is a primary glaucoma or a secondary glaucoma.

9. The method of claim 8, wherein the primary glaucoma is selected from the group consisting of primary open angle glaucoma, normal-tension glaucoma, and angle-closure glaucoma.

10. The method of claim 8, wherein the secondary glaucoma is selected from the group consisting of pseudoexfoliation glaucoma, pigmentary glaucoma, neovascular glaucoma, steroid-induced glaucoma, and treatment refractory glaucoma.

11. The method of claim 6, wherein the ocular disease is ischemic optic neuropathy.

12. The method of claim 11, wherein the ischemic optic neuropathy is non-arteritic anterior ischemic optic neuropathy (NAION).

13. The method of claim 1, wherein the ocular neuroprotection comprises neuroprotection of the optic nerve.

14. The method of claim 1, wherein the otic composition is designed for instillation, deposition or spraying into the canal of the subject's ear.

15. The method of claim 1, wherein the otic composition is formulated as a cream, a foam, a paste, an ointment, an emulsion, a liquid solution, an ear drop, a gel, spray, a suspension, a microemulsion, microspheres, microcapsules, nanospheres, nanoparticles, lipid vesicles, liposomes, polymeric vesicles, a patch, or an insert.

16. The method of claim 15, wherein the otic composition is formulated as a liquid solution.

17. The method of claim 1, wherein the target gene is selected from the group consisting of APP, MAPT, SOD1, CASP1, CASP2, CASP9, TGM2, TARDBP, CAMK2A, CBLN1, CDK5R1, MAPK10, NPTX2, NRGN, PDCD2, PENK, SYT1, FUS, CYBA, ATF3, HRK, C1QBP, BNIP3, MAPKB, MAPK14, Rac1, GSK3B, P2RX7, TRPM2, PARG, BMP2, GJA1, TYROBP, CTGF, ANXA2, RHOA, DDIT4 (RTPBO1), DDIT4L (RTP801L), NOX4, NOX2 (gp91pho, CYBB), NOXO1, NCF1 NOXA1, NCF2 (p67phox, NOXA2), p53 (TP53), HTRA2, KEAP1, SHC1, ZNHIT1, LGALS3, HI95(SESN2), CTSD, CAPNS1, FAS, CAPN1, FADD, NGFR, HTT (huntingtin), RTN4 (NogoA), T (tenascin C), NRP1, TNFRSF19(TROY), ROCK1, CFL1 (cofilin), KCNC4, KCNE3, FKBP1A, DYRK1A, AKAP13, UBE2K, SEPHS1, HMGB1, HMGB2, BECN1, THEM4, NMP9, PRNP, EPHA4, EPHA7 and EFNB2.

18. The method of claim 1, wherein the target gene is CASP2.

19. The method of claim 1, wherein the penetration enhancer is glycerol.

20. The method of claim 19, wherein glycerol is present at an amount equal to 0.1-35% (v/v).

* * * * *